(12) United States Patent
Aivado et al.

(10) Patent No.: US 11,091,522 B2
(45) Date of Patent: Aug. 17, 2021

(54) PEPTIDOMIMETIC MACROCYCLES AND USES THEREOF

(71) Applicant: Aileron Therapeutics, Inc., Watertown, MA (US)

(72) Inventors: Manuel Aivado, Chester Springs, PA (US); Vincent Guerlavais, Arlington, MA (US); Karen Olson, Waltham, MA (US); David Allen Annis, Cambridge, MA (US)

(73) Assignee: Aileron Therapeutics, Inc., Watertown, MA (US)

( * ) Notice: Subject to any disclaimer, the term of this patent is extended or adjusted under 35 U.S.C. 154(b) by 0 days.

(21) Appl. No.: 16/519,550

(22) Filed: Jul. 23, 2019

(65) Prior Publication Data

US 2020/0040048 A1 Feb. 6, 2020

Related U.S. Application Data

(60) Provisional application No. 62/738,700, filed on Sep. 28, 2018, provisional application No. 62/701,943, filed on Jul. 23, 2018.

(51) Int. Cl.
*C07K 14/47* (2006.01)
*A61K 38/00* (2006.01)

(52) U.S. Cl.
CPC .......... *C07K 14/4738* (2013.01); *A61K 38/00* (2013.01)

(58) Field of Classification Search
CPC ............ C07K 14/4738; C07K 14/4746; A61K 38/00; A61K 31/7016; A61K 31/506; A61K 31/7064; A61K 45/06; A61K 38/12; A61K 31/519
See application file for complete search history.

(56) References Cited

U.S. PATENT DOCUMENTS

| | | | |
|---|---|---|---|
| 5,702,908 A | 12/1997 | Picksley et al. |
| 5,708,136 A | 1/1998 | Burrell et al. |
| 5,756,669 A | 5/1998 | Bischoff et al. |
| 5,770,377 A | 6/1998 | Picksley et al. |
| 5,874,529 A | 2/1999 | Gilon et al. |
| 6,153,391 A | 11/2000 | Picksley et al. |
| 6,169,073 B1 | 1/2001 | Halazonetis et al. |
| 6,245,886 B1 | 6/2001 | Halazonetis et al. |
| 6,420,118 B1 | 7/2002 | Halazonetis et al. |
| 6,784,157 B2 | 8/2004 | Halazonetis et al. |
| 7,083,983 B2 | 8/2006 | Lane et al. |
| 7,183,059 B2 | 2/2007 | Verdine et al. |
| 7,189,801 B2 | 3/2007 | Halazonetis et al. |
| 7,192,713 B1 | 3/2007 | Verdine et al. |
| 7,202,332 B2 | 4/2007 | Arora et al. |
| 7,666,983 B2 | 2/2010 | Halazonetis et al. |
| 7,705,118 B2 | 4/2010 | Arora et al. |
| 7,723,469 B2 | 5/2010 | Walensky et al. |
| 7,786,072 B2 | 8/2010 | Verdine et al. |
| 7,960,506 B2 | 6/2011 | Nash |
| 7,981,998 B2 | 7/2011 | Nash |
| 7,981,999 B2 | 7/2011 | Nash |
| 8,067,424 B2 | 11/2011 | Jogalekar et al. |
| 8,071,541 B2 | 12/2011 | Arora et al. |
| 8,198,405 B2 | 6/2012 | Walensky et al. |
| 8,324,428 B2 | 12/2012 | Verdine et al. |
| 8,343,760 B2 | 1/2013 | Lu et al. |
| 8,399,405 B2 | 3/2013 | Nash et al. |
| 8,524,653 B2 | 9/2013 | Nash et al. |
| 8,592,377 B2 | 11/2013 | Verdine et al. |
| 8,609,809 B2 | 12/2013 | Nash |
| 8,637,686 B2 | 1/2014 | Nash |
| 8,796,418 B2 | 8/2014 | Walensky et al. |
| 8,808,694 B2 | 8/2014 | Nash et al. |
| 8,859,723 B2 | 10/2014 | Guerlavais et al. |
| 8,889,632 B2 | 11/2014 | Bernal et al. |
| 8,895,699 B2 | 11/2014 | Verdine et al. |
| 8,927,500 B2 | 1/2015 | Guerlavais et al. |
| 8,987,414 B2 | 3/2015 | Guerlavais et al. |
| 9,023,988 B2 | 5/2015 | Nash |
| 9,096,684 B2 | 8/2015 | Kawahata et al. |
| 9,163,330 B2 | 10/2015 | Verdine et al. |
| 9,175,045 B2 | 11/2015 | Nash et al. |
| 9,175,047 B2 | 11/2015 | Nash et al. |
| 9,175,056 B2 | 11/2015 | Nash |
| 9,206,223 B2 | 12/2015 | Nash et al. |
| 9,273,031 B2 | 3/2016 | Errico et al. |

(Continued)

FOREIGN PATENT DOCUMENTS

| | | | |
|---|---|---|---|
| AU | 2008232709 A1 | 10/2008 |
| CA | 2761253 A1 | 6/2013 |

(Continued)

OTHER PUBLICATIONS

Teveroni et al [Expert Opinion on Therapeutic Patents, 2016, vol. 26, No. 12, 1417-1429] (Year: 2016).*
Abbas, et al. (2010). Mdm2 is required for survival of hematopoietic stem cells/progenitors via dampening of ROS-induced p53 activity. Cell Stem Cell 7, 606-617.
Abraham, et al. (2016). Dual targeting of p53 and c-MYC selectively eliminates leukaemic stem cells. Nature 534, 341-346.
Al-Lazikani, et al. Combinatorial drug therapy for cancer in the post-genomic era. Nature biotechnology 30.7 (2012): 679-692.
Andreeff, et al. (2016). Results of the Phase I Trial of RG7112, a Small-Molecule MDM2 Antagonist in Leukemia. Clin Cancer Res 22, 868-876.
Baek, et al. Structure of the stapled p53 peptide bound to Mdm2. J Am Chem Soc. Jan. 11, 2012;134(1):103-6. doi: 10.1021/ja2090367. Epub Dec. 14, 2011.

(Continued)

*Primary Examiner* — Sudhakar Katakam
(74) *Attorney, Agent, or Firm* — Wilson Sonsini Goodrich & Rosati

(57) ABSTRACT

The present disclosure describes the synthesis of peptidomimetic macrocycles and methods of using peptidomimetic macrocycles to treat a condition. The present disclosure also describes methods of using peptidomimetic macrocycles in combination with at least one additional pharmaceutically-active agent for the treatment of a condition, for example, cancer.

21 Claims, 46 Drawing Sheets

Specification includes a Sequence Listing.

(56) References Cited

U.S. PATENT DOCUMENTS

| | | | |
|---|---|---|---|
| 9,273,099 B2 | 3/2016 | Walensky et al. | |
| 9,394,336 B2 | 7/2016 | Nash et al. | |
| 9,408,885 B2 | 8/2016 | Marine | |
| 9,458,202 B2 | 10/2016 | Nash et al. | |
| 9,464,115 B2 | 10/2016 | Walensky et al. | |
| 9,486,445 B2 | 11/2016 | Higgins et al. | |
| 9,493,509 B2 | 11/2016 | Nash | |
| 9,505,801 B2 | 11/2016 | Verdine et al. | |
| 9,505,804 B2 * | 11/2016 | Guerlavais | C07K 1/113 |
| 9,522,947 B2 | 12/2016 | Kawahata et al. | |
| 9,527,896 B2 | 12/2016 | Bernal et al. | |
| 9,556,227 B2 | 1/2017 | Verdine et al. | |
| 9,604,919 B2 | 3/2017 | Darlak et al. | |
| 9,605,026 B2 | 3/2017 | Arora et al. | |
| 9,617,309 B2 | 4/2017 | Verdine et al. | |
| 9,675,661 B2 | 6/2017 | Nash | |
| 9,845,287 B2 | 12/2017 | Darlak et al. | |
| 9,951,099 B2 | 4/2018 | Verdine et al. | |
| 9,956,243 B2 | 5/2018 | Higgins et al. | |
| 9,957,296 B2 | 5/2018 | Nash et al. | |
| 9,957,299 B2 | 5/2018 | Guerlavais et al. | |
| 10,022,422 B2 | 7/2018 | Nash et al. | |
| 10,023,613 B2 | 7/2018 | Guerlavais et al. | |
| 10,030,049 B2 | 7/2018 | Nash | |
| 10,059,741 B2 | 8/2018 | Annis et al. | |
| 10,202,431 B2 | 2/2019 | Bernal et al. | |
| 10,213,477 B2 | 2/2019 | Guerlavais et al. | |
| 10,227,380 B2 | 3/2019 | Guerlavais et al. | |
| 10,246,491 B2 | 4/2019 | Guerlavais et al. | |
| 10,253,067 B2 | 4/2019 | Chen et al. | |
| 10,300,109 B2 | 5/2019 | Nash et al. | |
| 10,301,351 B2 | 5/2019 | Verdine et al. | |
| 10,308,699 B2 | 6/2019 | Kawahata et al. | |
| 10,328,117 B2 | 6/2019 | Nash | |
| 10,464,975 B2 | 11/2019 | Walensky et al. | |
| 10,471,120 B2 | 11/2019 | Chen et al. | |
| 10,487,110 B2 | 11/2019 | Verdine et al. | |
| 2002/0132977 A1 | 9/2002 | Yuan et al. | |
| 2003/0060432 A1 | 3/2003 | Tocque et al. | |
| 2003/0176318 A1 | 9/2003 | Gudkov et al. | |
| 2004/0146971 A1 | 7/2004 | Lane et al. | |
| 2005/0137137 A1 | 6/2005 | Lane et al. | |
| 2005/0222224 A1 | 10/2005 | Gudkov et al. | |
| 2005/0227932 A1 | 10/2005 | Lu et al. | |
| 2005/0250680 A1 | 11/2005 | Walensky et al. | |
| 2006/0008848 A1 | 1/2006 | Verdine et al. | |
| 2006/0014675 A1 | 1/2006 | Arora et al. | |
| 2006/0100143 A1 | 5/2006 | Lu et al. | |
| 2007/0197772 A1 | 8/2007 | Arora et al. | |
| 2008/0161426 A1 | 7/2008 | Gudkov et al. | |
| 2008/0242598 A1 | 10/2008 | Fairlie et al. | |
| 2009/0149630 A1 | 6/2009 | Walensky et al. | |
| 2009/0176964 A1 | 7/2009 | Walensky et al. | |
| 2009/0326192 A1 | 12/2009 | Nash et al. | |
| 2010/0168388 A1 | 7/2010 | Bernal et al. | |
| 2010/0184645 A1 | 7/2010 | Verdine et al. | |
| 2010/0234563 A1 | 9/2010 | Arora et al. | |
| 2011/0183917 A1 | 7/2011 | Lu et al. | |
| 2012/0082636 A1 | 4/2012 | Walensky et al. | |
| 2012/0156197 A1 | 6/2012 | Errico et al. | |
| 2012/0270800 A1 | 10/2012 | Verdine et al. | |
| 2013/0005943 A1 | 1/2013 | Arora et al. | |
| 2014/0018302 A1 | 1/2014 | Walensky et al. | |
| 2014/0378390 A1 | 12/2014 | Guerlavais et al. | |
| 2016/0024153 A1 | 1/2016 | Verdine et al. | |
| 2016/0038498 A1 | 2/2016 | Bussey et al. | |
| 2016/0101145 A1 | 4/2016 | Annis et al. | |
| 2016/0115204 A1 | 4/2016 | Nash et al. | |
| 2016/0193283 A1 | 7/2016 | Chen et al. | |
| 2016/0244494 A1 | 8/2016 | Verdine et al. | |
| 2016/0287569 A1 | 10/2016 | Caenepeel et al. | |
| 2016/0303158 A1 | 10/2016 | Higgins et al. | |
| 2016/0333049 A1 | 11/2016 | Chen et al. | |
| 2016/0339023 A1 | 11/2016 | Li et al. | |
| 2017/0008930 A1 | 1/2017 | Walensky et al. | |
| 2017/0037105 A1 | 2/2017 | Samant | |
| 2017/0066799 A1 | 3/2017 | Verdine et al. | |
| 2017/0081379 A1 | 3/2017 | Bernal et al. | |
| 2017/0112809 A1 | 4/2017 | Orwar et al. | |
| 2017/0114098 A1* | 4/2017 | Aivado | A61K 31/7068 |
| 2017/0165240 A1 | 6/2017 | Ghanem et al. | |
| 2017/0212125 A1 | 7/2017 | Nash et al. | |
| 2017/0340733 A1 | 11/2017 | Cao | |
| 2018/0008688 A1 | 1/2018 | Munn | |
| 2018/0064808 A1 | 3/2018 | Friess et al. | |
| 2018/0085426 A1 | 3/2018 | Nash et al. | |
| 2018/0100001 A1 | 4/2018 | Verdine et al. | |
| 2018/0104270 A1 | 4/2018 | Jordan | |
| 2018/0193346 A1 | 7/2018 | Ferretti et al. | |
| 2018/0265459 A1 | 9/2018 | Darlak et al. | |
| 2018/0282818 A1 | 10/2018 | Murphy | |
| 2018/0305400 A1 | 10/2018 | Verdine et al. | |
| 2018/0371021 A1 | 12/2018 | Aivado et al. | |
| 2019/0029224 A1 | 1/2019 | Murphy et al. | |
| 2019/0062377 A1 | 2/2019 | Guerlavais et al. | |
| 2019/0071469 A1 | 3/2019 | Nash et al. | |
| 2019/0255650 A1 | 8/2019 | Chung | |
| 2019/0256559 A1 | 8/2019 | Chen et al. | |
| 2019/0269753 A1 | 9/2019 | Chen et al. | |

FOREIGN PATENT DOCUMENTS

| | | |
|---|---|---|
| CN | 1906209 A | 1/2007 |
| CN | 102223891 A | 10/2011 |
| EP | 0643726 B1 | 8/1999 |
| EP | 0977580 B1 | 4/2003 |
| EP | 0958305 B1 | 6/2008 |
| EP | 2377849 A2 | 10/2011 |
| EP | 2637680 A2 | 9/2013 |
| EP | 2228452 B1 | 7/2014 |
| EP | 3204412 A2 | 8/2017 |
| EP | 3405194 A1 | 11/2018 |
| JP | 2010518017 A | 5/2010 |
| JP | 2010120881 A | 6/2010 |
| JP | 2010519318 A | 6/2010 |
| WO | WO-9602642 A1 | 2/1996 |
| WO | WO-9714794 A1 | 4/1997 |
| WO | WO-9726002 A1 | 7/1997 |
| WO | WO-9801467 A2 | 1/1998 |
| WO | WO-9847525 A1 | 10/1998 |
| WO | WO-9851707 A1 | 11/1998 |
| WO | WO-2005044839 A2 | 5/2005 |
| WO | WO-2005118620 A2 | 12/2005 |
| WO | WO-2008014216 A1 | 1/2008 |
| WO | WO-2008095063 A1 | 8/2008 |
| WO | WO-2008104000 A2 | 8/2008 |
| WO | WO-2008106507 A2 | 9/2008 |
| WO | WO-2008121767 A2 | 10/2008 |
| WO | WO-2009149339 A2 | 12/2009 |
| WO | WO-2010013011 A1 | 2/2010 |
| WO | WO-2010058819 A1 | 5/2010 |
| WO | WO-2011008260 A2 | 1/2011 |
| WO | WO-2012021876 A2 | 2/2012 |
| WO | WO-2012047587 A2 | 4/2012 |
| WO | WO-2012080389 A1 | 6/2012 |
| WO | WO-2012083078 A2 | 6/2012 |
| WO | WO-2013036208 A2 | 3/2013 |
| WO | WO-2013123266 A1 | 8/2013 |
| WO | WO-2014052647 A2 | 4/2014 |
| WO | WO-2015017803 A1 | 2/2015 |
| WO | WO-2016040892 A1 | 3/2016 |
| WO | WO-2016049355 A1 | 3/2016 |
| WO | WO-2016049359 A1 | 3/2016 |
| WO | WO-2016154058 A1 | 9/2016 |
| WO | WO-2017165299 A2 | 9/2017 |
| WO | WO-2017165617 A1 | 9/2017 |
| WO | WO-2017205786 A1 | 11/2017 |
| WO | WO-2018092020 A1 | 5/2018 |
| WO | WO-2018106870 A1 | 6/2018 |
| WO | WO-2018115380 A1 | 6/2018 |
| WO | WO-2018160758 A1 | 9/2018 |
| WO | WO-2018165575 A2 | 9/2018 |

(56) References Cited

FOREIGN PATENT DOCUMENTS

WO  WO-2018185135 A1  10/2018
WO  WO-2018208954 A3  12/2018

OTHER PUBLICATIONS

Barker et al., Mining the Wnt pathway for cancer therapeutics. Nat Rev Drug Discov. Dec. 2006;5(12):997-1014.
Bernal, et al. A stapled p53 helix overcomes HDMX-mediated suppression of p53. Cancer Cell. Nov. 16, 2010;18(5):411-22. doi: 10.1016/j.ccr.2010.10.024.
Bernal, et al. Reactivation of the p53 tumor suppressor pathway by a stapled p53 peptide. J Am Chem Soc. Mar. 7, 2007;129(9):2456-7.
Bottger, et al. Molecular characterization of the hdm2-p53 interaction. J Mol Biol. Jun. 27, 1997;269(5):744-56.
Brown, et al. Stapled peptides with improved potency and specificity that activate p53. ACS Chem Biol. Mar. 15, 2013;8(3):506-12. doi: 10.1021/cb3005148. Epub Dec. 18, 2012.
Bueso-Ramos, et al. (1993). The human MDM-2 oncogene is overexpressed in leukemias. Blood 82, 2617-2623.
Burgess, et al. (2016). Clinical Overview of MDM2/X-Targeted Therapies. Front Oncol. 2016; 6: 7.
Chang, et al. Stapled α-helical peptide drug development: a potent dual inhibitor of MDM2 and MDMX for p53-dependent cancer therapy. Proc Natl Acad Sci U S A. Sep. 3, 2013;110(36):E3445-54. doi: 10.1073/pnas.1303002110. Epub Aug. 14, 2013.
Chang et al., Transactivation of miR-34a by p53 broadly influences gene expression and promotes apoptosis.Mol. Cell., 26(5):745-752, 2007.
Chen, et al. Dual inhibition of PI3K and mTOR mitigates compensatory AKT activation and improves tamoxifen response in breast cancer. Mol Cancer Res. Oct. 2013;11(10):1269-78. doi: 10.1158/1541-7786.MCR-13-0212. Epub Jun. 27, 2013.
Cheng et al., Emerging role of RAB GTPases in cancer and human disease. Cancer Res. Apr. 1, 2005;65(7):2516-9.
Cheng et al., The RAB25 small GTPase determines aggressiveness of ovarian and breast cancers. Nat Med. Nov. 2004;10(11):1251-6. Epub Oct. 24, 2004.
Chia et al., Emerging roles for Rab family GTPases in human cancer. Biochim Biophys Acta. Apr. 2009;1795(2):110-6.
Chène et al., "Study of the Cytotoxic Effect of a Peptidic Inhibitor of the p53-hdm2 Interaction in Tumor Cells," FEBS Lett. 529:293-297 (2002).
Chène, P., "Inhibiting the p53-MDM2 Interaction: An Important Target for Cancer Therapy," Nat Rev. Cancer 3:102-109 (2003).
Cummings, et al. Disrupting protein-protein interactions with non-peptidic, small molecule alpha-helix mimetics. Curr Opin Chem Biol. Jun. 2010;14(3):341-6. doi: 10.1016/j.cbpa.2010.04.001. Epub Apr. 27, 2010.
Fischer, et al. Apoptosis-based therapies and drug targets. Cell Death and Differentiation. 2005; 12:942-961.
Fischer, P. Peptide, Peptidomimetic, and Small-molecule Antagonists of the p53-HDM2 Protein-Protein Interaction. Int J Pept Res Ther. Mar. 2006;12(1):3-19. Epub Mar. 15, 2006.
Fulda, et al. Extrinsic versus intrinsic apoptosis pathways in anti-cancer chemotherapy. Oncogene. Aug. 7, 2006;25(34):4798-811.
Gante, Peptidomimetics—Tailored Enzyme Inhibitors. J Angew Chem Int Ed Engl. 1994;33:1699-1720.
García-Echeverría et al., "Discovery of Potent Antagonists of the Interaction between Human Double Minute 2 and Tumor Suppressor p53," J. Med. Chem. 43:3205-3208 (2000).
Gu, et al. (2002). Mutual dependence of MDM2 and MDMX in their functional inactivation of p53. J Biol Chem 277, 19251-19254.
Guerlavais, et al. Advancements in Stapled Peptide Drug Discovery & Development. Annual Reports in Medicinal Chemistry, vol. 49 49 (2014): 331-345.
Guo et al., Probing the alpha-helical structural stability of stapled p53 peptides: molecular dynamics simulations and analysis. Chem Biol Drug Des. Apr. 2010;75(4):348-59. doi: 10.1111/j.1747-0285.2010.00951.x.

Haupt, et al. (1997). Mdm2 promotes the rapid degradation of p53. Nature 387, 296-299.
Henchey, et al. High specificity in protein recognition by hydrogen-bond-surrogate α-helices: selective inhibition of the p53/MDM2 complex. Chembiochem. Oct. 18, 2010;11(15):2104-7. doi: 10.1002/cbic.201000378.
Honda, et al. Oncoprotein MDM2 is a ubiquitin ligase E3 for tumor suppressor p53. FEBS Lett. Dec. 22, 1997;420(1):25-7.
Hu, et al. Efficient p53 activation and apoptosis by simultaneous disruption of binding to MDM2 and MDMX. Cancer Res. Sep. 15, 2007;67(18):8810-7.
International Search Report and Written Opinion in Corresponding PCT application PCT/US2019/043019 dated Nov. 12, 2019.
Ji, et al. In vivo activation of the p53 tumor suppressor pathway by an engineered cyclotide. J Am Chem Soc. Aug. 7, 2013;135(31):11623-33. doi: 10.1021/ja405108p. Epub Jul. 25, 2013.
Jones, et al. (1998). Overexpression of Mdm2 in mice reveals a p53-independent role for Mdm2 in tumorigenesis. Proc Natl Acad Sci U S A 95, 15608-15612.
Kallen, et al. Crystal structures of human MdmX(HdmX) in complex with p53 peptide analogues reveal surprising conformational changes. Journal of Biological Chemistry. Mar. 27, 2009; 284:8812-8821.
Kandoth et al. Mutational landscape and significance across 12 major cancer types. Nature 502(7471):333-339 (2013).
Kritzer et al., "Helical β-Peptide Inhibitors of the p53-hDM2 Interaction," J. Am. Chem. Soc. 126:9468-9469 (2004).
Kubbutat, et al. Regulation of p53 stability by Mdm2. Nature. May 15, 1997;387(6630):299-303.
Kussie et al, "Structure of the MDM2 Oncoprotein Bound to the p53 Tumor Suppressor Transactivation Domain," Science 274:948-953 (1996).
Kwon, et al. Quantitative comparison of the relative cell permeability of cyclic and linear peptides. Chem Biol. Jun. 2007;14(6):671-7.
Lau, et al. Investigating peptide sequence variations for 'double-click' stapled p53 peptides. Org Biomol Chem. Jun. 28, 2014;12(24):4074-7.
Li, et al. (2012). Activation of p53 by SIRT1 inhibition enhances elimination of CML leukemia stem cells in combination with imatinib. Cancer Cell 21, 266-281.
Li, et al. (2014). MDM4 overexpressed in acute myeloid leukemia patients with complex karyotype and wild-type TP53. PLoS One 9, e113088.
Li, et al. Systematic mutational analysis of peptide inhibition of the p53-MDM2/MDMX interactions. J Mol Biol. Apr. 30, 2010;398(2):200-13. doi: 10.1016/j.jmb.2010.03.005. Epub Mar. 10, 2010.
Li, et at. Molecular-targeted agents combination therapy for cancer: Developments and potentials. International Journal of Cancer 134.6 (2014): 1257-1269.
Lu, et al. Proteomimetic libraries: design, synthesis, and evaluation of p53-MDM2 interaction inhibitors. J Comb Chem. May-Jun. 2006;8(3):315-25.
Lucking et al. "Identification of Atuveciclib (BAY 1143572), the First Highly Selective, Clinical PTEFb/CDK9 Inhibitor for the Treatment of Cancer" ChemMedChem. Oct. 16, 2017 (Oct. 16, 2017) vol. 12, p. 1776-1793; p. 1776, abstract, p. 1778, left col., para 2.
Madden, et al. Synthesis of cell-permeable stapled peptide dual inhibitors of the p53-Mdm2/Mdmx interactions via photoinduced cycloaddition. Bioorg Med Chem Lett. Mar. 1, 2011;21(5):1472-5. doi: 10.1016/j.bmcl.2011.01.004. Epub Jan. 7, 2011.
Murray, et al. Targeting protein-protein interactions: lessons from p53/MDM2. Biopolymers. 2007;88(5):657-86.
Nahi, et al. Mutated and non-mutated TP53 as targets in the treatment of leukaemia. Br J Haematol. May 2008;141(4):445-53.
Oliner, et al. Oncoprotein MDM2 conceals the activation domain of tumour suppressor p53. Nature. Apr. 29, 1993;362(6423):857-60.
Peller, et al. (2003). TP53 in hematological cancer: low incidence of mutations with significant clinical relevance. Hum Mutat 21, 277-284.

(56) References Cited

OTHER PUBLICATIONS

Phan, et al. Structure-based design of high affinity peptides inhibiting the interaction of p53 with MDM2 and MDMX. J Biol Chem. Jan. 15, 2010;285(3):2174-83. doi: 10.1074/jbc.M109.073056. Epub Nov. 12, 2009.

Picksley et al., Immunochemical analysis of the interaction of p53 with MDM2;—fine mapping of the MDM2 binding site on p53 using synthetic peptides. Oncogene. Sep. 1994;9(9):2523-9.

Reis, et al. (2016). Acute myeloid leukemia patients' clinical response to idasanutlin (RG7388) is associated with pre-treatment MDM2 protein expression in leukemic blasts. Haematologica 101, e185-188.

Rivlin, et al. Mutations in the p53 Tumor Suppressor Gene: Important Milestones at the Various Steps of Tumorigenesis. Genes & Cancer 2011, 2:466. Originally published online May 18, 2011.

Shangary, et al. Targeting the MDM2-p53 interaction for cancer therapy. Clin Cancer Res. Sep. 1, 2008;14(17):5318-24. doi: 10.1158/1078-0432.CCR-07-5136.

Shvarts, et al. (1996). MDMX: a novel p53-binding protein with some functional properties of MDM2. EMBO J 15, 5349-5357.

Stad, et al. (2000). Hdmx stabilizes Mdm2 and p53. J Biol Chem 275, 28039-28044.

Stad, et al. (2001). Mdmx stabilizes p53 and Mdm2 via two distinct mechanisms. EMBO Rep 2, 1029-1034.

Tan, et al. (2014). High Mdm4 levels suppress p53 activity and enhance its half-life in acute myeloid leukaemia. Oncotarget 5, 933-943.

Verdine et al., Stapled peptides for intracellular drug targets. Methods Enzymol. 2012;503:3-33. doi: 10.1016/B978-0-12-396962-0.00001-X.

Walensky, et al. Hydrocarbon-stapled peptides: principles, practice, and progress. J Med Chem. Aug. 14, 2014;57(15):6275-88. doi: 10.1021/jm4011675. Epub Mar. 6, 2014.

Yin et al. Terphenyl-based Helical Mimetics That Disrupt the p53/HDM2 Interaction. Angew. Chem. Int. Ed. 44:2704-2707 (2005).

Zhang, et al. Chemopreventive agents induce programmed death-1-ligand 1 (PD-L1) surface expression in breast cancer cells and promote PD-L1-mediated T cell apoptosis. Mol Immunol. Mar. 2008;45(5):1470-6. Epub Oct. 24, 2007.

Zhang, et al. Targeting p53-MDM2-MDMX loop for cancer therapy. Subcell Biochem. 2014;85:281-319. doi: 10.1007/978-94-017-9211-0_16.

Zhao, et al. (2010). p53 loss promotes acute myeloid leukemia by enabling aberrant self-renewal. Genes Dev 24, 1389-1402.

Zhao, et al. (2015). Small-molecule inhibitors of the MDM2-p53 protein-protein interaction (MDM2 Inhibitors) in clinical trials for cancer treatment. J Med Chem 58, 1038-1052.

Zhu, et al. Mechanisms of relapse in acute leukaemia: involvement of p53 mutated subclones in disease progression in acute lymphoblastic leukaemia. Br J Cancer. Mar. 1999;79(7-8):1151-7.

* cited by examiner

A. After 7 days exposure to treatment

B. Then washout and another 7 days to regrow

PEPTIDOMIMETIC MACROCYCLES AND USES THEREOF

CROSS REFERENCE

This application claims the benefit of U.S. Provisional Application No. 62/701,943, filed Jul. 23, 2018, and U.S. Provisional Application No. 62/738,700 filed Sep. 28, 2018, each of which is incorporated herein by reference in its entirety.

SEQUENCE LISTING

The instant application contains a Sequence Listing which has been submitted electronically in ASCII format and is hereby incorporated by reference in its entirety. Said ASCII copy, created on Aug. 20, 2019, is named 35224-829_201_SL.txt and is 1,597,273 bytes in size.

BACKGROUND

The human transcription factor protein p53 induces cell cycle arrest and apoptosis in response to DNA damage and cellular stress, and thereby plays a critical role in protecting cells from malignant transformation. The E3 ubiquitin ligase MDM2, also known as HDM2, negatively regulates p53 function through a direct binding interaction, which neutralizes the p53 transactivation activity. Loss of p53 activity, either by deletion, mutation, or MDM2 overexpression, is the most common defect in human cancers.

INCORPORATION BY REFERENCE

All publications, patents, and patent applications mentioned in this specification are herein incorporated by reference to the same extent as if each individual publication, patent, or patent application was specifically and individually indicated to be incorporated by reference.

SUMMARY

In some embodiments, the disclosure provides a method of treating a condition in a subject in need thereof, the method comprising administering to the subject a therapeutic amount of a p53 activator and a therapeutically-effective amount of a cyclin dependent kinase inhibitor (CDKI), wherein the therapeutically-effective amount of the cyclin dependent kinase inhibitor is 1-250 mg.

In some embodiments, the disclosure provides a method of treating a condition in a subject in need thereof, the method comprising administering to the subject: (a) a pharmaceutical composition, wherein the pharmaceutical composition comprises a therapeutically-effective amount of a p53 activator and trehalose; and (b) a therapeutically-effective amount of a cyclin dependent kinase inhibitor (CDKI).

In some embodiments, the disclosure provides a method of treating a condition in a subject in need thereof, the method comprising administering to the subject a therapeutically-effective amount of a p53 activator and a therapeutically-effective amount of cyclin dependent kinase inhibitor (CDKI), wherein: (a) the therapeutically-effective amount of the CDKI is 1-250 mg; and (b) when, in a controlled study, a treatment regimen comprising: (i) 20 mg per kilogram of body weight of the p53 activator administered once per week during a 22 day period; and (ii) 75 mg per kilogram of body weight of the CDKI administered once per day during the 22 day period; is administered to each mouse of a group of 10 mice, wherein each mouse has a MCF-7 tumor, median growth of the MCF-7 tumors in the group of 10 mice occurs with at most a 30% deviation from line 4 or 5 as in FIG. 32.

In some embodiments, the disclosure provides a method of treating a condition in a subject in need thereof, the method comprising administering to the subject a therapeutically-effective amount of a p53 activator and a therapeutically-effective amount of cyclin dependent kinase inhibitor (CDKI), wherein: (a) the therapeutically-effective amount of the CDKI is 1-250 mg; and (b) when, in a controlled study, a treatment regimen comprising: (i) 20 mg per kilogram of body weight of the p53 activator administered once per week during a 22 day period; and (ii) 75 mg per kilogram of body weight of the CDKI administered once per day during the 22 day period; is administered to each mouse of a group 10 mice, wherein each mouse has a SJSA-1 tumor, median growth of the SJSA-1 tumors in the group of 10 mice occurs with at most a 30% deviation from line 4 or 5 as illustrated in FIG. 33:

In some embodiments, the disclosure provides a method of treating a condition in a subject in need thereof, the method comprising administering to the subject a therapeutically-effective amount of a p53 activator and a therapeutically-effective amount of cyclin dependent kinase inhibitor (CDKI), wherein: (a) the therapeutically-effective amount of the CDKI is 1-250 mg; and (b) when, in a controlled study a treatment regimen comprising: (i) 20 mg per kilogram of body weight of a p53 activator administered twice per week for a 22 day period; (ii) 100 mg per kilogram of body weight of a CDKI administered once per day on days 1-14 of the 22 day period; and (iii) 75 mg per kilogram of body weight of a CDKI administered once per day on days 18-22 of the 22 day period; is administered to each mouse of a group of 8-10 mice, wherein each mouse has a MCF-7 tumor, median growth of the MCF-7 tumors in the group of 8-10 mice occurs with at most a 30% deviation from line 3 as illustrated in FIG. 36.

In some embodiments, the disclosure provides a method of treating a condition in a subject in need thereof, the method comprising administering to the subject a therapeutically-effective amount of a p53 activator and a therapeutically-effective amount of cyclin dependent kinase inhibitor (CDKI), wherein: (a) the therapeutically-effective amount of the CDKI is 1-250 mg; and (b) when, in a controlled study, a treatment regimen comprising: (i) 10 mg per kilogram of body weight of a p53 activator administered twice per week for a 22 day period; (ii) 100 mg per kilogram of body weight of a CDKI administered once per day on days 1-14 of the 22 day period; and (iii) 75 mg per kilogram of body weight of a CDKI administered once per day on days 18-22 of the 22 day period; is administered to each mouse of a group of 8-10 mice, wherein each mouse has a MCF-7 tumor, median growth of the MCF-7 tumors in the group of 8-10 mice occurs with at most a 30% deviation from line 5 as illustrated in FIG. 36.

In some embodiments, the disclosure provides a method of treating a subject with a tumor, the method comprising administering to the subject a therapeutically-effective amount of a p53 activator and a therapeutically-effective amount of cyclin dependent kinase inhibitor (CDKI), wherein: (a) the therapeutically-effective amount of the CDKI is 1-250 mg; and (b) when, in a controlled study, a treatment regimen comprising: (i) 20 mg per kilogram of body weight of a p53 activator administered twice per week for a 22 day period; (ii) 100 mg per kilogram of body weight of a CDKI administered once per day on days 1-14 of the 22 day period; and (iii) 75 mg per kilogram of body weight of a CDKI administered once per day on days 18-22 of the 22 day period; is administered to each mouse of a group of 8-10 mice, wherein each mouse has a MCF-7 tumor, the group of 8-10 mice generate a survival curve with at most 30% deviation from line 3 as illustrated in FIG. 37.

In some embodiments, the disclosure provides a method of treating a subject with a tumor, the method comprising administering to the subject a therapeutically-effective amount of a p53 activator and a therapeutically-effective amount of cyclin dependent kinase inhibitor (CDKI), wherein: (a) the therapeutically-effective amount of the CDKI is 1-250 mg; and (b) when, in a controlled study, a treatment regimen comprising: (i) 10 mg per kilogram of body weight of a p53 activator administered twice per week for a 22 day period; (ii) 100 mg per kilogram of body weight of a CDKI administered once per day on days 1-14 of the 22 day period; and (iii) 75 mg per kilogram of body weight of a CDKI administered once per day on days 18-22 of the 22 day period; is administered to each mouse of a group of 8-10 mice, wherein each mouse has a MCF-7 tumor, the group of 8-10 mice generate a survival curve with at most 30% deviation from line 5 as illustrated in FIG. 37.

In some embodiments, the disclosure provides a method of treating a subject with a tumor, the method comprising administering to the subject a therapeutically-effective amount of a p53 activator and a therapeutically-effective amount of cyclin dependent kinase inhibitor (CDKI), wherein: (a) the therapeutically-effective amount of the CDKI is 1-250 mg; and (b) when, in a controlled study, a treatment regimen comprising: (i) 20 mg per kilogram of body weight of the p53 activator administered twice per week during a 22 day period; and (ii) 75 mg per kilogram of body weight of the CDKI administered once per day during the 22 day period; is administered to each mouse of a group of 10 mice, wherein each mouse has a MCF-7 tumor, median growth of the MCF-7 tumors in the group of 10 mice occurs with at most a 30% deviation from line 4 as illustrated in FIG. 38.

In some embodiments, the disclosure provides a method of treating a subject with a tumor, the method comprising administering to the subject a therapeutically-effective amount of a p53 activator and a therapeutically-effective amount of cyclin dependent kinase inhibitor (CDKI), wherein: (a) the therapeutically-effective amount of the CDKI is 1-250 mg; and (b) when, in a controlled study, a treatment regimen comprising: (i) 10 mg per kilogram of body weight of the p53 activator administered twice per week during a 22 day period; and (ii) 75 mg per kilogram of body weight of the CDKI administered once per day during the 22 day period; is administered to each mouse of a group of 10 mice, wherein each mouse has a MCF-7 tumor, median growth of the MCF-7 tumors in the group of 10 mice occurs with at most a 30% deviation from line 5 as illustrated in FIG. 38.

In some embodiments, the disclosure provides a method of treating a subject with a tumor, the method comprising administering to the subject a therapeutically-effective amount of a p53 activator and a therapeutically-effective amount of cyclin dependent kinase inhibitor (CDKI), wherein: (a) the therapeutically-effective amount of the CDKI is 1-250 mg; and (b) when, in a controlled study, a treatment regimen comprising: (i) 20 mg per kilogram of body weight of the p53 activator administered twice per week during a 22 day period; and (ii) 75 mg per kilogram of body weight of the CDKI administered once per day during the 22 day period; is administered to each mouse of a group of 10 mice, wherein each mouse has a MCF-7 tumor, the group of 10 mice generate a survival curve with at most a 30% deviation from line 4 as illustrated in FIG. 39.

In some embodiments, the disclosure provides a method of treating a subject with a tumor, the method comprising administering to the subject a therapeutically-effective amount of a p53 activator and a therapeutically-effective amount of cyclin dependent kinase inhibitor (CDKI), wherein: (a) the therapeutically-effective amount of the CDKI is 1-250 mg; and (b) when, in a controlled study, a treatment regimen comprising: (i) 10 mg per kilogram of body weight of the p53 activator administered twice per week during a 22 day period; and (ii) 75 mg per kilogram of body weight of the CDKI administered once per day during the 22 day period; is administered to each mouse of a group of 10 mice, wherein each mouse has a MCF-7 tumor, the group of 10 mice generate a survival curve with at most a 30% deviation from line 5 as illustrated in FIG. 39.

In some embodiments, the disclosure provides a method of treating a subject with a tumor, the method comprising administering to the subject a therapeutically-effective amount of a p53 activator and a therapeutically-effective amount of cyclin dependent kinase inhibitor (CDKI), wherein: (a) the therapeutically-effective amount of the CDKI is 1-250 mg; and (b) when, in a controlled study, a treatment regimen comprising: (i) 20 mg per kilogram of body weight of the p53 activator administered twice per week during a 22 day period; and (ii) 75 mg per kilogram of body weight of the CDKI administered once per day during the 22 day period; is administered to each mouse of a group of 10 mice, wherein each mouse has a MCF-7 tumor, median growth of the MCF-7 tumors in the group of 10 mice occurs with at most a 30% deviation from line 4 as illustrated in FIG. 34.

In some embodiments, the disclosure provides a method of treating a subject with a tumor, the method comprising administering to the subject a therapeutically-effective amount of a p53 activator and a therapeutically-effective amount of cyclin dependent kinase inhibitor (CDKI), wherein: (a) the therapeutically-effective amount of the CDKI is 1-250 mg; and (b) when, in a controlled study, a treatment regimen comprising: (i) 10 mg per kilogram of body weight of the p53 activator administered twice per week during a 22 day period; and (ii) 75 mg per kilogram of body weight of the CDKI administered once per day during the 22 day period; is administered to each mouse of a group of 10 mice, wherein each mouse has a MCF-7 tumor, median growth of the MCF-7 tumors in the group of 10 mice occurs with at most a 30% deviation from line 5 as illustrated in FIG. 34.

In some embodiments, the disclosure provides a method of treating a subject with a tumor, the method comprising administering to the subject a therapeutically-effective amount of a p53 activator and a therapeutically-effective amount of cyclin dependent kinase inhibitor (CDKI), wherein: (a) the therapeutically-effective amount of the CDKI is 1-250 mg; and (b) when, in a controlled study, a treatment regimen comprising: (i) 20 mg per kilogram of body weight of the p53 activator administered twice per week during a 22 day period; and (ii) 75 mg per kilogram of body weight of the CDKI administered once per day during the 22 day period; is administered to each mouse of a group of 10 mice, wherein each mouse has a MCF-7 tumor, the group of 10 mice generate a survival curve with at most a 30% deviation from line 4 as illustrated in FIG. 35.

In some embodiments, the disclosure provides a method of treating a subject with a tumor, the method comprising administering to the subject a therapeutically-effective amount of a p53 activator and a therapeutically-effective amount of cyclin dependent kinase inhibitor (CDKI), wherein: (a) the therapeutically-effective amount of the CDKI is 1-250 mg; and (b) when, in a controlled study, a treatment regimen comprising: (i) 10 mg per kilogram of body weight of the p53 activator administered twice per week during a 22 day period; and (ii) 75 mg per kilogram of body weight of the CDKI administered once per day during the 22 day period; is administered to each mouse of a group of 10 mice, wherein each mouse has a MCF-7 tumor, the group of 10 mice generate a survival curve with at most a 30% deviation from line 5 as illustrated in FIG. 35.

In some embodiments, the disclosure provides a method of treating a subject with a tumor, the method comprising administering to the subject a therapeutically-effective amount of a p53 activator and a therapeutically-effective amount of cyclin dependent kinase inhibitor (CDKI), wherein: (a) the therapeutically-effective amount of the CDKI is 1-250 mg; and (b) when, in a controlled study, a treatment regimen comprising: (i) 20 mg per kilogram of body weight of the p53 activator administered twice per week during a 22 day period; and (ii) 75 mg per kilogram of body weight of the CDKI administered once per day during the 22 day period; is administered to each mouse of a group of 10 mice, wherein each mouse has a SJSA-1 tumor, median growth of the SJSA-1 tumors in the group of 10 mice occurs with at most a 30% deviation from line 4 or 5 as illustrated in FIG. 41.

In some embodiments, the disclosure provides a method of treating a subject with a tumor, the method comprising administering to the subject a therapeutically-effective amount of a p53 activator and a therapeutically-effective amount of cyclin dependent kinase inhibitor (CDKI), wherein: (a) the therapeutically-effective amount of the CDKI is 1-250 mg; and (b) when, in a controlled study, a treatment regimen comprising: (i) 20 mg per kilogram of body weight of the p53 activator administered twice per week during a 22 day period; and (ii) 75 mg per kilogram of body weight of the CDKI administered once per day during the 22 day period; is administered to each mouse of a group of 10 mice, wherein each mouse has a SJSA-1 tumor, the group of 10 mice generate a survival curve with at most a 30% deviation from line 4 or line 5 as illustrated in FIG. 42.

BRIEF DESCRIPTION OF THE FIGURES

FIG. 9 PANEL B shows that caspase was evident with sustained apoptotic effects after a 24 hour pulse treatment with AP1. FIG. 9 PANEL C shows that caspase activation was not evident from 24 hour pulse treatment with palbociclib alone or in combination with AP1.

FIG. 10 PANEL B shows that the BrdU incorporation assay demonstrated dose-dependent synergistic effects when palbociclib was used for a 96 hour treatment course and when AP1 was used to treat the cells for 24 hours first and followed by a 96 hour treatment with palbociclib. FIG. 10 PANEL C shows that the BrdU incorporation assay did not demonstrate synergistic effects when palbociclib was used for a 24 hour pulse treatment alone or in combination with AP1.

FIG. 14 PANEL B shows that a 24 hour pulse treatment with AP1 and subsequent treatment with palbociclib resulted in dose-dependent synergistic effects on cell cycle inhibition in MCF7 cells compared to a 24 hour pulse treatment with AP1 alone or treatment with palbociclib alone. FIG. 14 PANEL C shows that a 24 hour pulse treatment with palbociclib and subsequent treatment with AP1 resulted in dose-dependent synergistic effects on cell cycle inhibition in MCF7 cells compared to a 24 hour pulse treatment with AP1 alone or treatment with palbociclib alone.

FIG. 17 BOTTOM PANEL shows that cells that were treated with AP1 and palbociclib, washed, and regrown exhibited sustained inhibition of cellular proliferation in MCF7 cells.

FIG. 18 PANEL B shows that cells that were treated with AP1+abemaciclib or AP1+palbociclib, washed, and regrown exhibited sustained inhibition of cellular proliferation in MCF7 cells.

FIG. 23 PANEL B shows that a 24 hour pulse treatment with AP1 followed by treatment with abemaciclib resulted in dose-dependent synergistic effects on cell cycle inhibition compared to a 24 hour pulse treatment of AP1 alone or a 96 hour treatment with abemaciclib alone. FIG. 23 PANEL C shows that a 24 hour pulse treatment with abemaciclib followed by treatment with AP1 resulted in dose-dependent synergistic effects on cell cycle inhibition compared to a 24 hour pulse treatment of abemaciclib alone or a 96 hour treatment with abemaciclib alone.

FIG. 24 PANEL B shows that a 24 hour pulse treatment with AP1 followed by treatment with abemaciclib resulted in sustained apoptotic effects in SJSA1 cells. FIG. 24 PANEL C shows that a 24 hour pulse treatment with abemaciclib attenuated apoptosis in SJSA1 cells.

FIG. 28 PANEL B shows that a 24 hour pulse treatment with AP1 followed by treatment with abemaciclib resulted in dose-dependent synergistic effects on cell cycle inhibition in MCF7 cells. FIG. 28 PANEL C shows that a 24 hour pulse treatment with abemaciclib followed by treatment with AP1 resulted in synergistic effects on cell cycle inhibition in MCF7 cells.

FIG. 40 PANEL B shows that treatment of SJSA xenograft model tumors with AP1, palbociclib, or combinations of AP1 and palbociclib resulted in decreased cell proliferation.

FIG. 43 PANEL B compares the plasma concentrations of palbociclib when administered alone (75 mg/kg) or in combination with AP1 (20 mg/kg).

DETAILED DESCRIPTION

Figure 1:
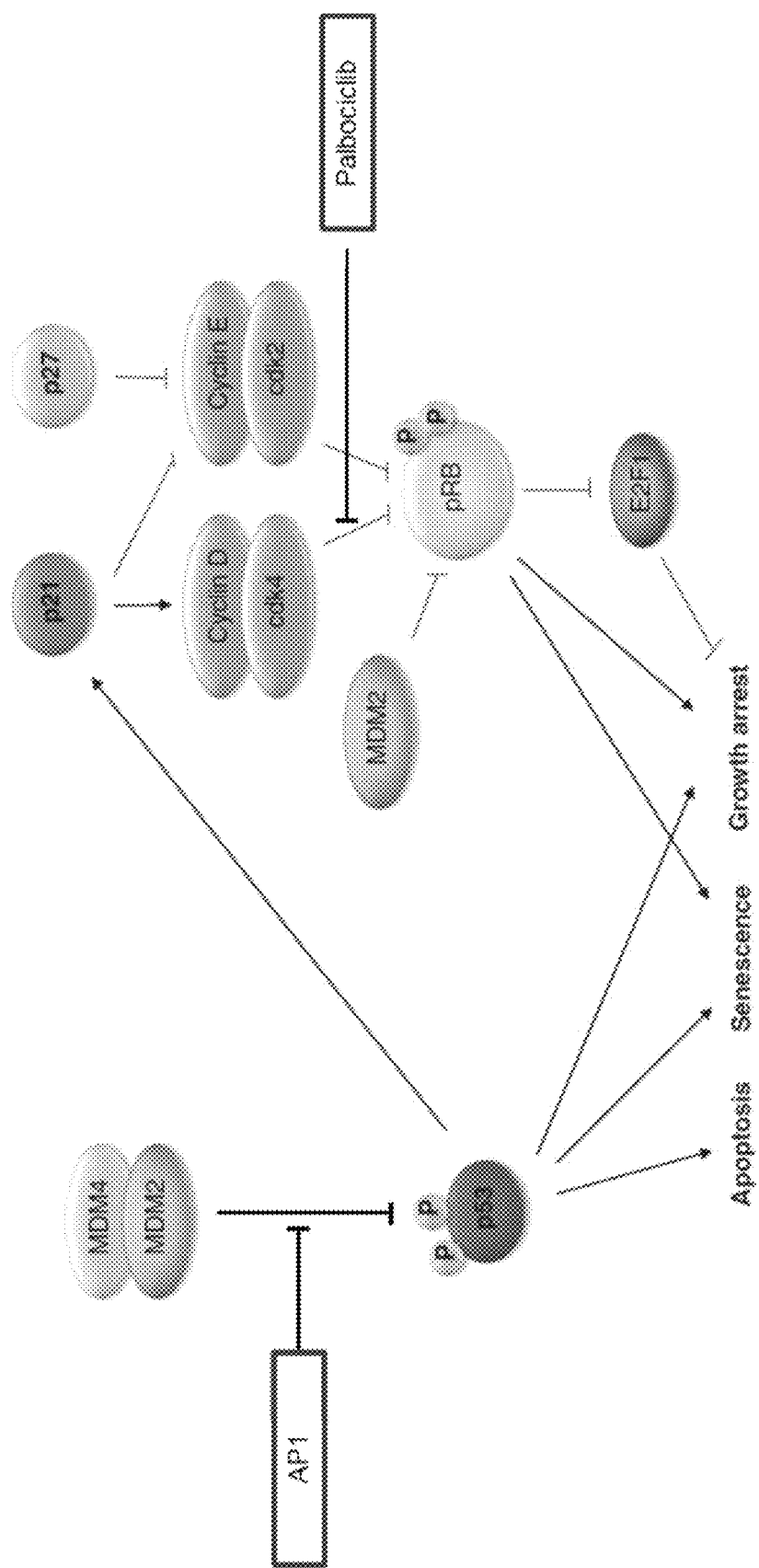
FIG. 1 shows that AP1 and palbociclib trigger apoptosis, senescence, and cell growth arrest.

The human transcription factor protein p53 induces cell cycle arrest and apoptosis in response to DNA damage and cellular stress, and thereby plays a critical role in protecting cells from malignant transformation. The E3 ubiquitin ligase MDM2, also known as HDM2, negatively regulates p53 function through a direct binding interaction that neutralizes the p53 transactivation activity. Neutralization of p53 transactivation activity leads to export from the nucleus of p53 protein, which targets p53 for degradation via the ubiquitylation-proteasomal pathway. Loss of p53 activity, either by deletion, mutation, or MDM2 overexpression, is the most common defect in human cancers. Tumors that express wild type p53 are vulnerable to pharmacologic agents that stabilize or increase the concentration of active p53.

MDMX (MDM4) is a negative regulator of p53, and there is significant structural homology between the p53 binding interfaces of MDM2 and MDMX. The p53-MDM2 and p53-MDMX protein-protein interactions are mediated by the same 15-residue alpha-helical transactivation domain of p53, which inserts into hydrophobic clefts on the surface of MDM2 and MDMX. Three residues within this domain of p53 (F19, W23, and L26) are essential for binding to MDM2 and MDMX.

Provided herein are p53-based peptidomimetic macrocycles that modulate an activity of p53 and p53-based peptidomimetic macrocycles that inhibit the interactions between p53 and MDM2 and/or p53 and MDMX proteins. Also provided herein are the use of p53-based peptidomimetic macrocycles and an additional therapeutic agent for the treatment of a condition. Further, provided herein are p53-based peptidomimetic macrocycles and additional therapeutic agents that can be used for treating diseases, for example, cancer and other hyperproliferative diseases.

Definitions

As used herein, the term "macrocycle" refers to a molecule having a chemical structure including a ring or cycle formed by at least 9 covalently bonded atoms.

As used herein, the term "peptidomimetic macrocycle" or "crosslinked polypeptide" refers to a compound comprising a plurality of amino acid residues joined by a plurality of peptide bonds and at least one macrocycle-forming linker which forms a macrocycle between a first naturally-occurring or non-naturally-occurring amino acid residue (or analogue) and a second naturally-occurring or non-naturally-occurring amino acid residue (or analogue) within the same molecule. Peptidomimetic macrocycle include embodiments where the macrocycle-forming linker connects the α-carbon of the first amino acid residue (or analogue) to the α-carbon of the second amino acid residue (or analogue). The peptidomimetic macrocycles optionally include one or more non-peptide bonds between one or more amino acid residues and/or amino acid analogue residues, and optionally include one or more non-naturally-occurring amino acid residues or amino acid analogue residues in addition to any which form the macrocycle. A "corresponding uncrosslinked polypeptide" when referred to in the context of a peptidomimetic macrocycle is understood to relate to a polypeptide of the same length as the macrocycle and comprising the equivalent natural amino acids of the wild-type sequence corresponding to the macrocycle.

AP1 is an alpha helical hydrocarbon crosslinked polypeptide macrocycle with an amino acid sequence less than 20 amino acids long that is derived from the transactivation domain of wild type human p53 protein. AP1 contains a phenylalanine, a tryptophan and a leucine amino acid in the same positions relative to each other as in the transactivation domain of wild type human p53 protein. AP1 has a single cross link spanning amino acids in the i to the i+7 position of the amino acid sequence and has more than three amino acids between the i+7 position and the carboxyl terminus. AP1 binds to human MDM2 and MDM4 and has an observed mass of 950-975 m/e as measured by electrospray ionization-mass spectrometry.

As used herein, the term "stability" refers to the maintenance of a defined secondary structure in solution by a peptidomimetic macrocycle as measured by circular dichroism, NMR or another biophysical measure, or resistance to proteolytic degradation in vitro or in vivo. Non-limiting examples of secondary structures contemplated herein are α-helices, $3_{10}$ helices, β-turns, and β-pleated sheets.

As used herein, the term "helical stability" refers to the maintenance of an α-helical structure by a peptidomimetic macrocycle as measured by circular dichroism or NMR. In some embodiments, a peptidomimetic macrocycle can exhibit at least a 1.25, 1.5, 1.75, or 2-fold increase in α-helicity as determined by circular dichroism compared to a corresponding uncrosslinked macrocycle.

The term "amino acid" refers to a molecule containing both an amino group and a carboxyl group. Suitable amino acids include, without limitation, both the D- and L-isomers of the naturally-occurring amino acids, as well as non-naturally-occurring amino acids prepared by organic synthesis or other metabolic routes. The term amino acid, as used herein, includes, without limitation, α-amino acids, natural amino acids, non-natural amino acids, and amino acid analogues.

The term "α-amino acid" refers to a molecule containing both an amino group and a carboxyl group bound to a carbon which is designated the α-carbon.

The term "β-amino acid" refers to a molecule containing both an amino group and a carboxyl group in a β configuration.

The term "naturally-occurring amino acid" refers to any one of the twenty amino acids commonly found in peptides synthesized in nature, and known by the one letter abbreviations A, R, N, C, D, Q, E, G, H, I, L, K, M, F, P, S, T, W, Y and V.

The following table shows a summary of the properties of natural amino acids:

| Amino Acid | 3-Letter Code | 1-Letter Code | Side-chain Polarity | Side-chain charge (pH 7.4) | Hydropathy Index |
|---|---|---|---|---|---|
| Alanine | Ala | A | nonpolar | neutral | 1.8 |
| Arginine | Arg | R | polar | positive | −4.5 |
| Asparagine | Asn | N | polar | neutral | −3.5 |
| Aspartic acid | Asp | D | polar | negative | −3.5 |
| Cysteine | Cys | C | polar | neutral | 2.5 |
| Glutamic acid | Glu | E | polar | negative | −3.5 |
| Glutamine | Gln | Q | polar | neutral | −3.5 |
| Glycine | Gly | G | nonpolar | neutral | −0.4 |
| Histidine | His | H | polar | Positive (10%) Neutral (90%) | −3.2 |
| Isoleucine | Ile | I | nonpolar | neutral | 4.5 |
| Leucine | Leu | L | nonpolar | neutral | 3.8 |
| Lysine | Lys | K | polar | positive | −3.9 |
| Methionine | Met | M | nonpolar | neutral | 1.9 |
| Phenylalanine | Phe | F | nonpolar | neutral | 2.8 |
| Proline | Pro | P | nonpolar | neutral | −1.6 |
| Serine | Ser | S | polar | neutral | −0.8 |
| Threonine | Thr | T | polar | neutral | −0.7 |
| Tryptophan | Trp | W | nonpolar | neutral | −0.9 |
| Tyrosine | Tyr | Y | polar | neutral | −1.3 |
| Valine | Val | V | nonpolar | neutral | 4.2 |

"Hydrophobic amino acids" include small hydrophobic amino acids and large hydrophobic amino acids. "Small hydrophobic amino acids" are glycine, alanine, proline, and analogues thereof. "Large hydrophobic amino acids" are valine, leucine, isoleucine, phenylalanine, methionine, tryptophan, and analogues thereof. "Polar amino acids" are serine, threonine, asparagine, glutamine, cysteine, tyrosine, and analogues thereof. "Charged amino acids" are lysine, arginine, histidine, aspartate, glutamate, and analogues thereof.

The term "amino acid analogue" refers to a molecule which is structurally similar to an amino acid and which can be substituted for an amino acid in the formation of a peptidomimetic macrocycle. Amino acid analogues include, without limitation, β-amino acids and amino acids wherein the amino or carboxy group is substituted by a similarly reactive group (e.g., substitution of the primary amine with a secondary or tertiary amine, or substitution of the carboxy group with an ester).

The term "non-natural amino acid" refers to an amino acid which is not one of the twenty amino acids commonly found in peptides synthesized in nature, and known by the one letter abbreviations A, R, N, C, D, Q, E, G, H, I, L, K, M, F, P, S, T, W, Y and V. Non-natural amino acids or amino acid analogues include, without limitation, structures according to the following:

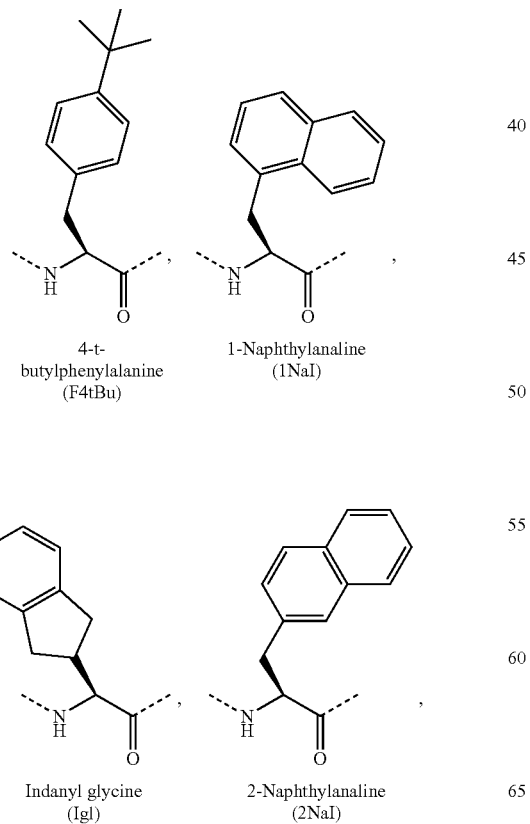

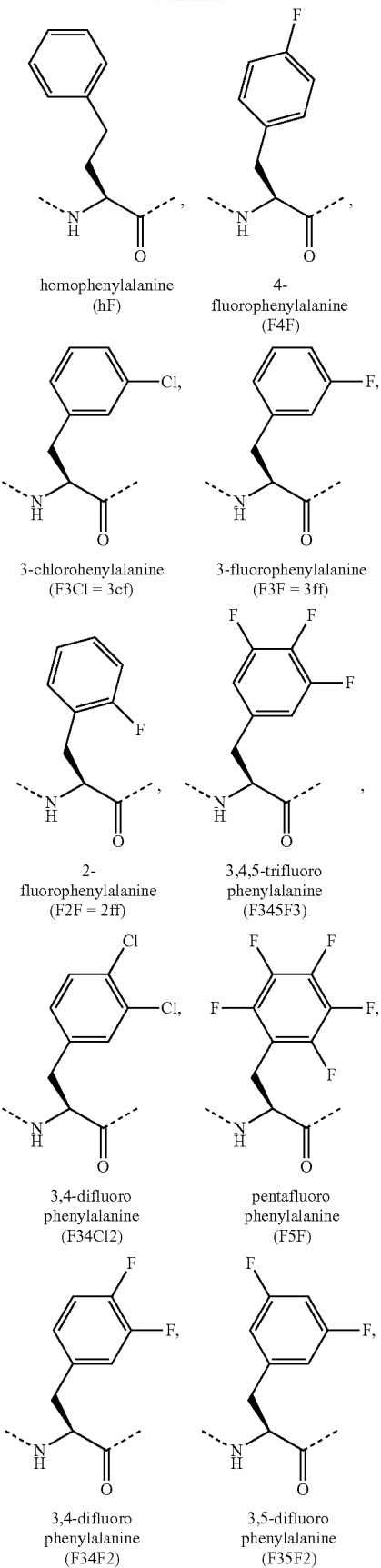

-continued

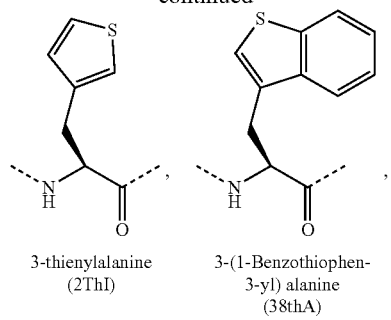

3-thienylalanine (2ThI)

3-(1-Benzothiophen-3-yl) alanine (3BthA)

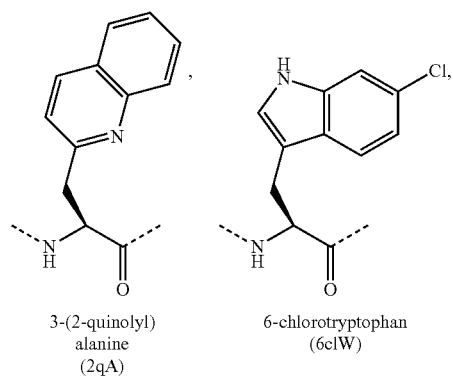

3-(2-quinolyl) alanine (2qA)

6-chlorotryptophan (6clW)

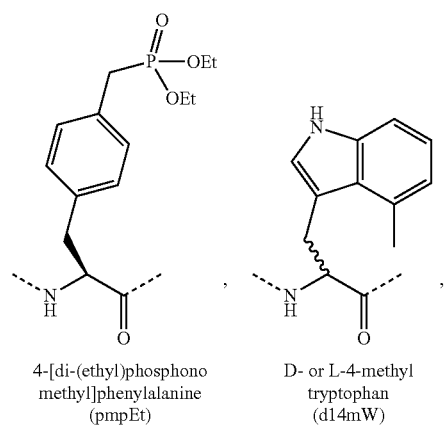

4-[di-(ethyl)phosphono methyl]phenylalanine (pmpEt)

D- or L-4-methyl tryptophan (d14mW)

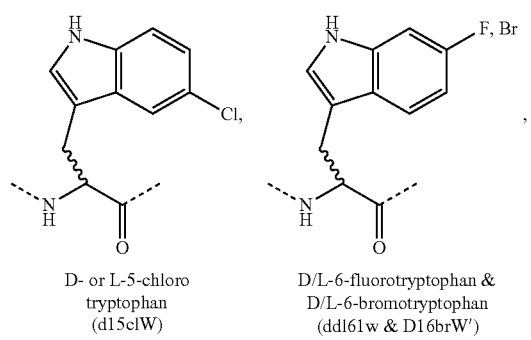

D- or L-5-chloro tryptophan (d15clW)

D/L-6-fluorotryptophan & D/L-6-bromotryptophan (dd16fw & D16brW')

-continued

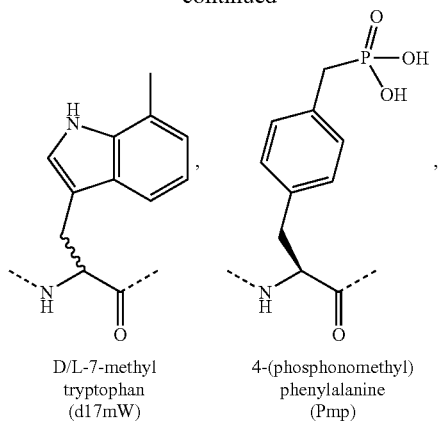

D/L-7-methyl tryptophan (d17mW)

4-(phosphonomethyl) phenylalanine (Pmp)

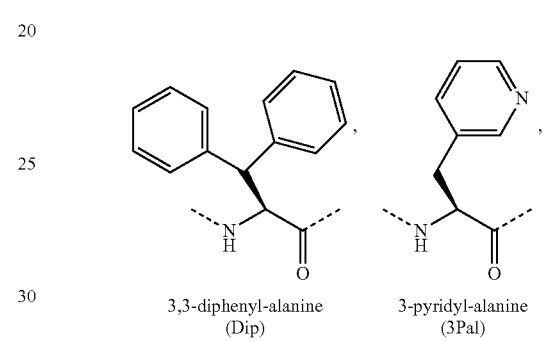

3,3-diphenyl-alanine (Dip)

3-pyridyl-alanine (3Pal)

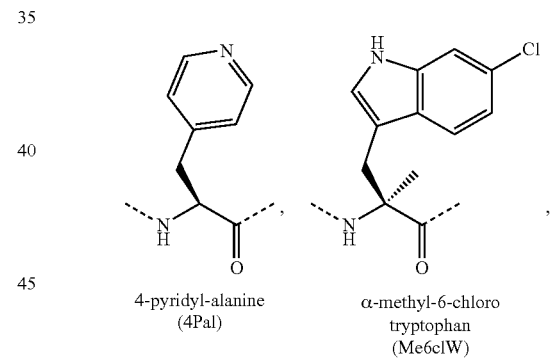

4-pyridyl-alanine (4Pal)

α-methyl-6-chloro tryptophan (Me6clW)

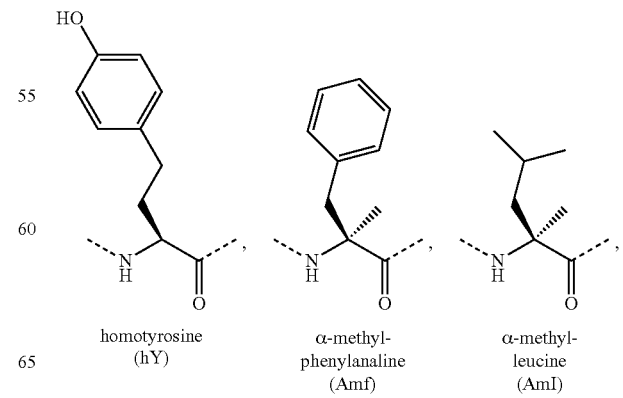

homotyrosine (hY)

α-methyl-phenylanaline (Amf)

α-methyl-leucine (AmI)

-continued
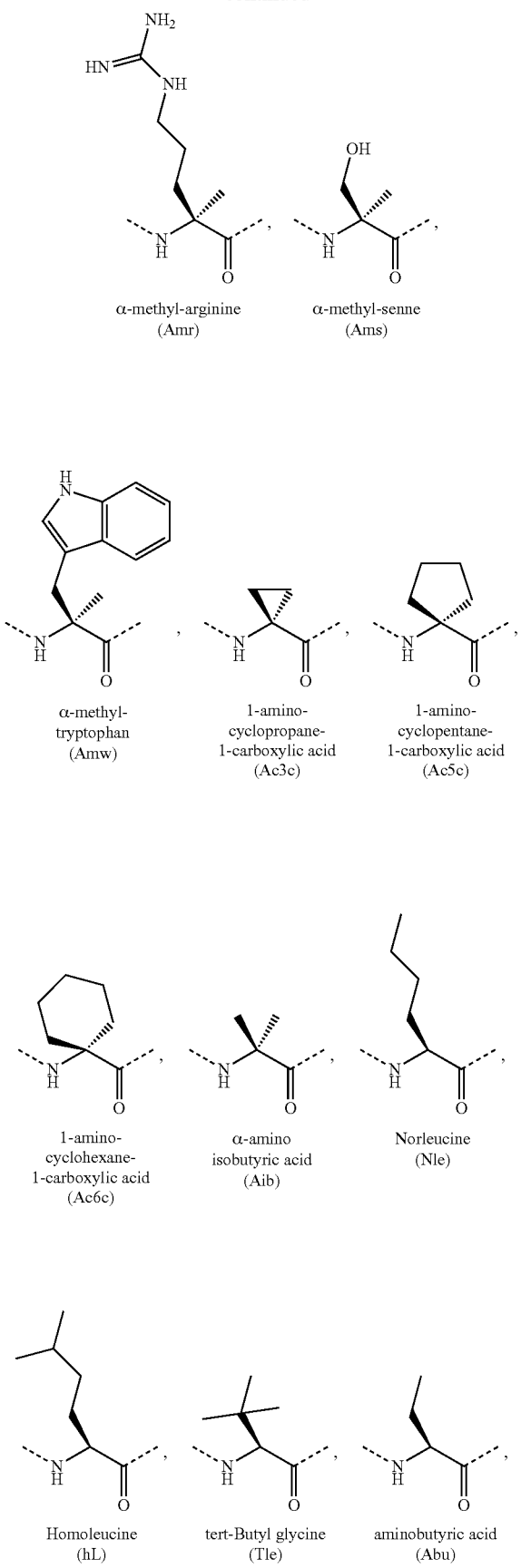
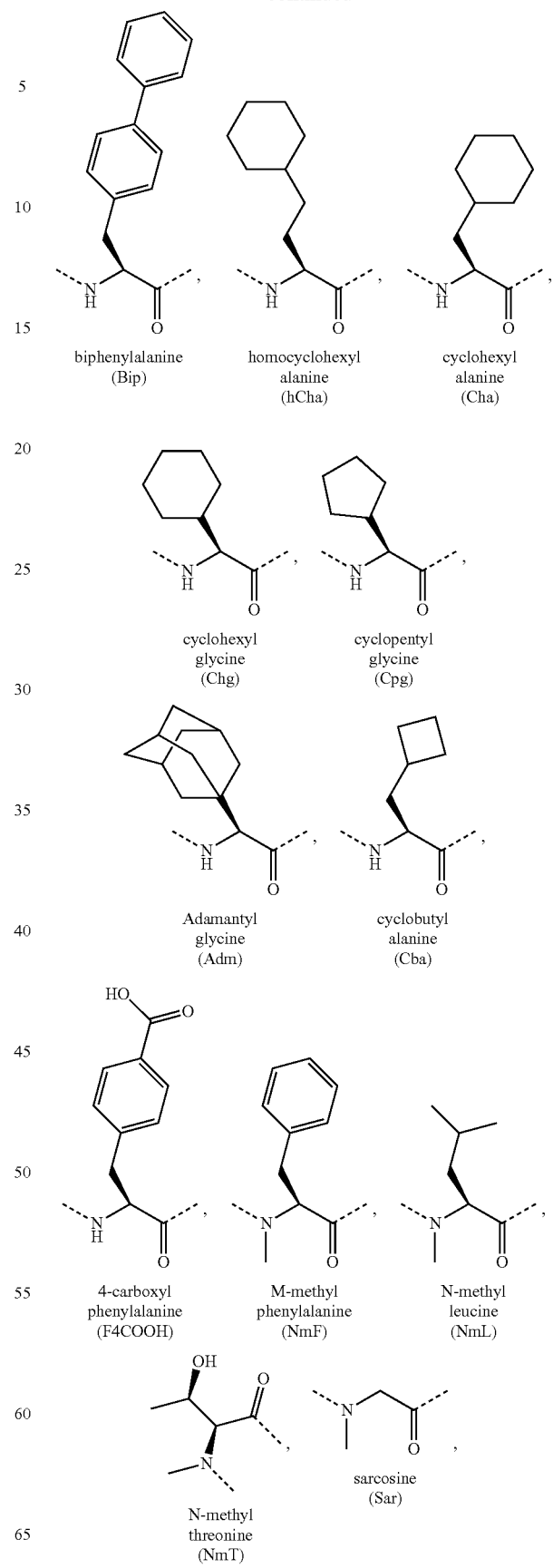

-continued

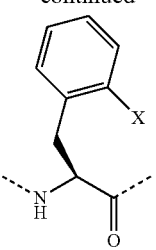

2-chlorophenylalanine (X = Cl),
2-bromophenylalanine (X = Br),
2-trimethylphenylalanine (X = CF3),
2-cyanophenylalanine (X = CN),
2-methylphenylalanine (X = Me),
2-nitrophenylalanine (X = NO2),
(F2X, X = Cl, Br, CF3, CN, Me, NO2)

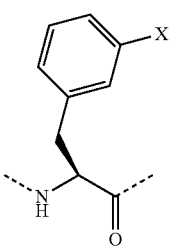

3-chlorophenylalanine (X = Cl),
3-bromophenylalanine (X = Br),
3-trimethylphenylalanine (X = CF3),
3-cyanophenylalanine (X = CN),
3-methylphenylalanine (X = Me),
3-nitrophenylalanine (X = NO2),
(F3X, X = Cl, Br, CF3, CN, Me, NO2)

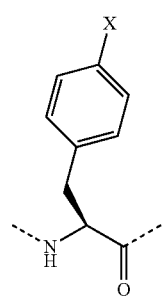

4-chlorophenylalanine (X = Cl),
4-bromophenylalanine (X = Br),
4-trimethylphenylalanine (X = CF3),
4-cyanophenylalanine (X = CN),
4-methylphenylalanine (X = Me),
4-nitrophenylalanine (X = NO2),
(F4X, X = Cl, Br, CF3, CN, Me, NO2)

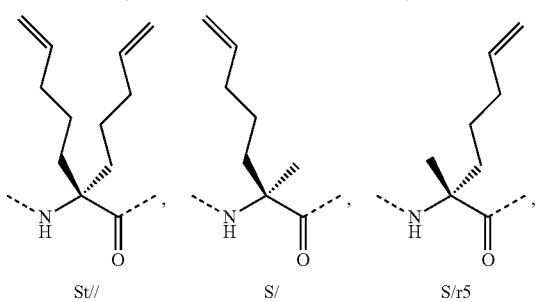

S/        S/        S/r5

-continued

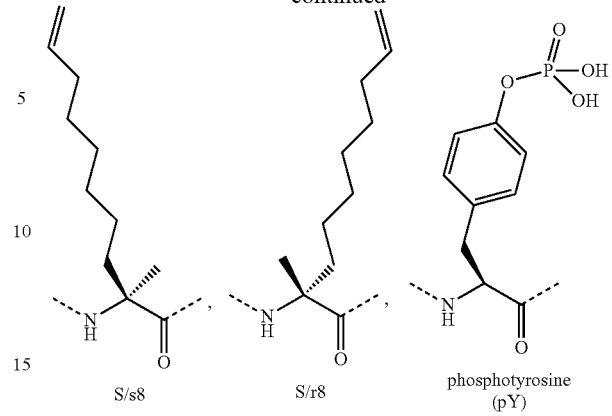

S/s8        S/r8        phosphotyrosine (pY)

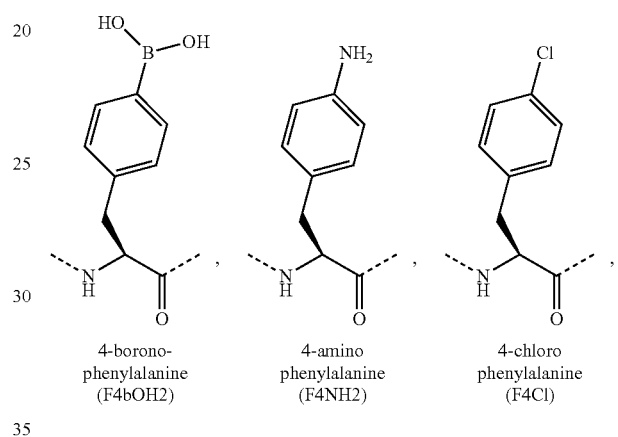

4-borono-phenylalanine (F4bOH2)    4-amino phenylalanine (F4NH2)    4-chloro phenylalanine (F4Cl)

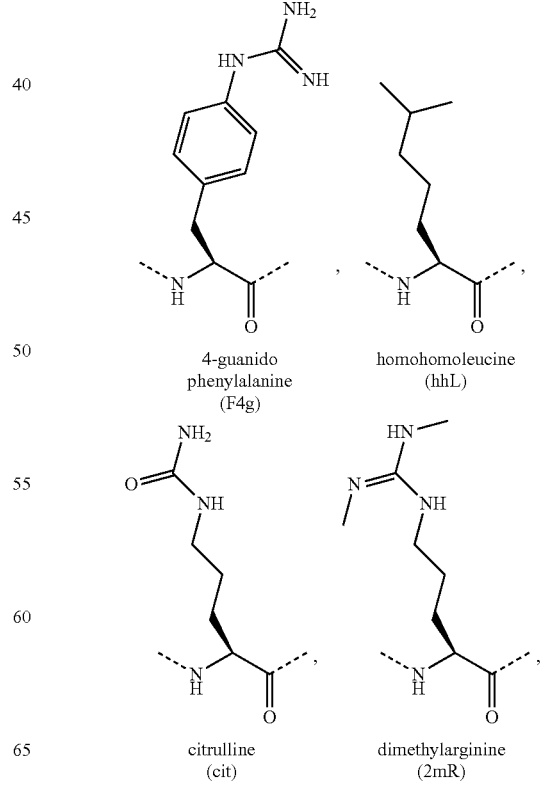

4-guanido phenylalanine (F4g)    homohomoleucine (hhL)

citrulline (cit)    dimethylarginine (2mR)

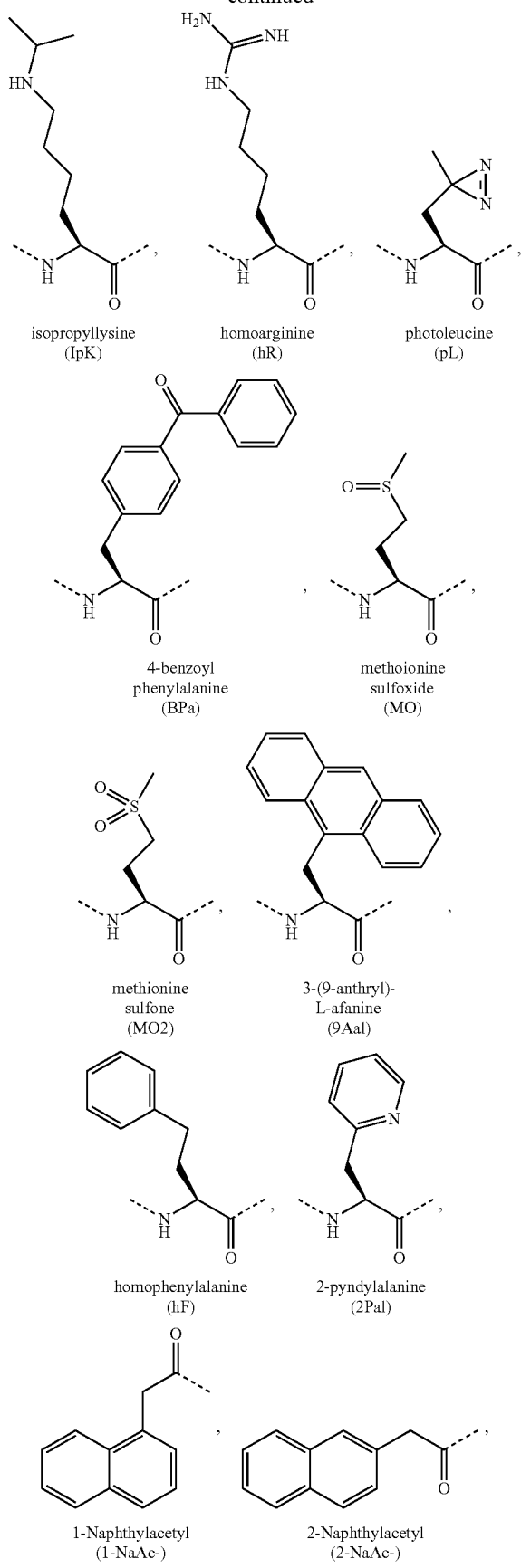

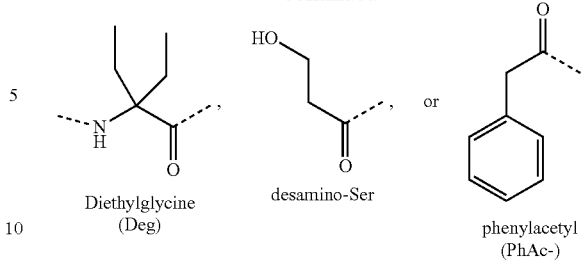

Diethylglycine (Deg), desamino-Ser, or phenylacetyl (PhAc-)

Amino acid analogues include β-amino acid analogues. Examples of β-amino acid analogues include, but are not limited to, the following: cyclic β-amino acid analogues; β-alanine; (R)-β-phenylalanine; (R)-1,2,3,4-tetrahydro-isoquinoline-3-acetic acid; (R)-3-amino-4-(1-naphthyl)-butyric acid; (R)-3-amino-4-(2,4-dichlorophenyl)butyric acid; (R)-3-amino-4-(2-chlorophenyl)-butyric acid; (R)-3-amino-4-(2-cyanophenyl)-butyric acid; (R)-3-amino-4-(2-fluorophenyl)-butyric acid; (R)-3-amino-4-(2-furyl)-butyric acid; (R)-3-amino-4-(2-methylphenyl)-butyric acid; (R)-3-amino-4-(2-naphthyl)-butyric acid; (R)-3-amino-4-(2-thienyl)-butyric acid; (R)-3-amino-4-(2-trifluoromethylphenyl)-butyric acid; (R)-3-amino-4-(3,4-dichlorophenyl)butyric acid; (R)-3-amino-4-(3,4-difluorophenyl)butyric acid; (R)-3-amino-4-(3-benzothienyl)-butyric acid; (R)-3-amino-4-(3-chlorophenyl)-butyric acid; (R)-3-amino-4-(3-cyanophenyl)-butyric acid; (R)-3-amino-4-(3-fluorophenyl)-butyric acid; (R)-3-amino-4-(3-methylphenyl)-butyric acid; (R)-3-amino-4-(3-pyridyl)-butyric acid; (R)-3-amino-4-(3-thienyl)-butyric acid; (R)-3-amino-4-(3-trifluoromethylphenyl)-butyric acid; (R)-3-amino-4-(4-bromophenyl)-butyric acid; (R)-3-amino-4-(4-chlorophenyl)-butyric acid; (R)-3-amino-4-(4-cyanophenyl)-butyric acid; (R)-3-amino-4-(4-fluorophenyl)-butyric acid; (R)-3-amino-4-(4-iodophenyl)-butyric acid; (R)-3-amino-4-(4-methylphenyl)-butyric acid; (R)-3-amino-4-(4-nitrophenyl)-butyric acid; (R)-3-amino-4-(4-pyridyl)-butyric acid; (R)-3-amino-4-(4-trifluoromethylphenyl)-butyric acid; (R)-3-amino-4-pentafluoro-phenylbutyric acid; (R)-3-amino-5-hexenoic acid; (R)-3-amino-5-hexynoic acid; (R)-3-amino-5-phenylpentanoic acid; (R)-3-amino-6-phenyl-5-hexenoic acid; (S)-1,2,3,4-tetrahydro-isoquinoline-3-acetic acid; (S)-3-amino-4-(1-naphthyl)-butyric acid; (S)-3-amino-4-(2,4-dichlorophenyl)butyric acid; (S)-3-amino-4-(2-chlorophenyl)-butyric acid; (S)-3-amino-4-(2-cyanophenyl)-butyric acid; (S)-3-amino-4-(2-fluorophenyl)-butyric acid; (S)-3-amino-4-(2-furyl)-butyric acid; (S)-3-amino-4-(2-methylphenyl)-butyric acid; (S)-3-amino-4-(2-naphthyl)-butyric acid; (S)-3-amino-4-(2-thienyl)-butyric acid; (S)-3-amino-4-(2-trifluoromethylphenyl)-butyric acid; (S)-3-amino-4-(3,4-dichlorophenyl)butyric acid; (S)-3-amino-4-(3,4-difluorophenyl)butyric acid; (S)-3-amino-4-(3-benzothienyl)-butyric acid; (S)-3-amino-4-(3-chlorophenyl)-butyric acid; (S)-3-amino-4-(3-cyanophenyl)-butyric acid; (S)-3-amino-4-(3-fluorophenyl)-butyric acid; (S)-3-amino-4-(3-methylphenyl)-butyric acid; (S)-3-amino-4-(3-pyridyl)-butyric acid; (S)-3-amino-4-(3-thienyl)-butyric acid; (S)-3-amino-4-(3-trifluoromethylphenyl)-butyric acid; (S)-3-amino-4-(4-bromophenyl)-butyric acid; (S)-3-amino-4-(4-chlorophenyl)-butyric acid; (S)-3-amino-4-(4-cyanophenyl)-butyric acid; (S)-3-amino-4-(4-fluorophenyl)-butyric acid; (S)-3-amino-4-(4-iodophenyl)-butyric acid; (S)-3-amino-4-(4-methylphenyl)-butyric acid; (S)-3-amino-4-(4-nitrophenyl)-butyric acid; (S)-3-amino-4-(4-pyridyl)-butyric acid; (S)-3-amino-4-(4-trifluoromethylphenyl)-butyric acid; (S)-3-amino-4-pentafluoro-phenylbutyric acid; (S)-3-amino-5-hexenoic acid; (S)-3-amino-5-hexynoic acid; (S)-3-amino-5-phenylpentanoic acid; (S)-3-amino-6-phenyl-5-hexenoic acid; 1,2,5,6-tetrahydropyridine-3-carboxylic acid; 1,2,5,6-tetrahydropyridine-4-carboxylic acid; 3-amino-3-(2-chlorophenyl)-propionic acid; 3-amino-3-(2-thienyl)-propionic acid; 3-amino-3-(3-bromophenyl)-propionic acid; 3-amino-3-(4-chlorophenyl)-propionic acid; 3-amino-3-(4-methoxyphenyl)-propionic acid; 3-amino-4,4,4-trifluoro-butyric acid; 3-aminoadipic acid; D-β-phenylalanine; β-leucine; L-β-homoalanine; L-β-homoaspartic acid γ-benzyl ester; L-β-homoglutamic acid δ-benzyl ester; L-β-homoisoleucine; L-β-homoleucine; L-β-homomethionine; L-β-homophenylalanine; L-β-homoproline; L-β-homotryptophan; L-β-homovaline; L-Nω-benzyloxycarbonyl-β-homolysine; Nω-L-β-homoarginine; O-benzyl-L-β-homohydroxyproline; O-benzyl-L-β-homoserine; O-benzyl-L-β-homothreonine; O-benzyl-L-β-homotyrosine; γ-trityl-L-β-homoasparagine; (R)-β-phenylalanine; L-β-homoaspartic acid γ-t-butyl ester; L-β-homoglutamic acid δ-t-butyl ester; L-Nω-β-homolysine; Nδ-trityl-L-β-homoglutamine; Nω-2,2,4,6,7-pentamethyl-dihydrobenzofuran-5-sulfonyl-L-β-homoarginine; O-t-butyl-L-β-homohydroxy-proline; O-t-butyl-L-β-homoserine; O-t-butyl-L-β-homothreonine; O-t-butyl-L-β-homotyrosine; 2-aminocyclopentane carboxylic acid; and 2-aminocyclohexane carboxylic acid.

Amino acid analogues include analogues of alanine, valine, glycine or leucine. Examples of amino acid analogues of alanine, valine, glycine, and leucine include, but are not limited to, the following: α-methoxyglycine; α-allyl-L-alanine; α-aminoisobutyric acid; α-methyl-leucine; β-(1-naphthyl)-D-alanine; β-(1-naphthyl)-L-alanine; β-(2-naphthyl)-D-alanine; β-(2-naphthyl)-L-alanine; β-(2-pyridyl)-D-alanine; β-(2-pyridyl)-L-alanine; β-(2-thienyl)-D-alanine; β-(2-thienyl)-L-alanine; β-(3-benzothienyl)-D-alanine; β-(3-benzothienyl)-L-alanine; β-(3-pyridyl)-D-alanine; β-(3-pyridyl)-L-alanine; β-(4-pyridyl)-D-alanine; β-(4-pyridyl)-L-alanine; β-chloro-L-alanine; β-cyano-L-alanine; β-cyclohexyl-D-alanine; β-cyclohexyl-L-alanine; β-cyclopenten-1-yl-alanine; β-cyclopentyl-alanine; β-cyclopropyl-L-Ala-OH.dicyclohexylammonium salt; β-t-butyl-D-alanine; β-t-butyl-L-alanine; γ-aminobutyric acid; L-α,β-diaminopropionic acid; 2,4-dinitro-phenylglycine; 2,5-dihydro-D-phenylglycine; 2-amino-4,4,4-trifluorobutyric acid; 2-fluoro-phenylglycine; 3-amino-4,4,4-trifluoro-butyric acid; 3-fluoro-valine; 4,4,4-trifluoro-valine; 4,5-dehydro-L-leu-OH.dicyclohexylammonium salt; 4-fluoro-D-phenylglycine; 4-fluoro-L-phenylglycine; 4-hydroxy-D-phenylglycine; 5,5,5-trifluoro-leucine; 6-aminohexanoic acid; cyclopentyl-D-Gly-OH.dicyclohexylammonium salt; cyclopentyl-Gly-OH.dicyclohexylammonium salt; D-α,β-diaminopropionic acid; D-α-aminobutyric acid; D-α-t-butylglycine; D-(2-thienyl)glycine; D-(3-thienyl)glycine; D-2-aminocaproic acid; D-2-indanylglycine; D-allylglycine.dicyclohexylammonium salt; D-cyclohexylglycine; D-norvaline; D-phenylglycine; β-aminobutyric acid; β-aminoisobutyric acid; (2-bromophenyl)glycine; (2-methoxyphenyl)glycine; (2-methylphenyl)glycine; (2-thiazoyl)glycine; (2-thienyl)glycine; 2-amino-3-(dimethylamino)-propionic acid; L-α,β-diaminopropionic acid; L-α-aminobutyric acid; L-α-t-butylglycine; L-(3-thienyl)glycine; L-2-amino-3-(dimethylamino)-propionic acid; L-2-aminocaproic acid dicyclohexyl-ammonium salt; L-2-indanylglycine; L-allylglycine.dicyclohexyl ammonium salt; L-cyclohexylglycine; L-phenylglycine; L-propargylglycine; L-norvaline; N-α-aminomethyl-L-alanine; D-α,γ-diaminobutyric acid; L-α,γ-diaminobutyric acid; β-cyclopropyl-L-alanine; (N-β-(2,4-dinitrophenyl))-L-α,β-diaminopropionic acid; (N-β-1-(4,4-dimethyl-2,6-dioxocyclohex-1-ylidene)ethyl)-D-α,β-diaminopropionic acid; (N-β-1-(4,4-dimethyl-2,6-dioxocyclohex-1-ylidene) ethyl)-L-α,β-diaminopropionic acid; (N-β-4-methyltrityl)-L-α,β-diaminopropionic acid; (N-β-allyloxycarbonyl)-L-α,β-diaminopropionic acid; (N-γ-1-(4,4-dimethyl-2,6-dioxocyclohex-1-ylidene)ethyl)-D-α,γ-diaminobutyric acid; (N-γ-1-(4,4-dimethyl-2,6-dioxocyclohex-1-ylidene)ethyl)-L-α,γ-diaminobutyric acid; (N-γ-4-methyltrityl)-D-α,γ-diaminobutyric acid; (N-γ-4-methyltrityl)-L-α,γ-diaminobutyric acid; (N-γ-allyloxycarbonyl)-L-α,γ-diaminobutyric acid; D-α,γ-diaminobutyric acid; 4,5-dehydro-L-leucine; cyclopentyl-D-Gly-OH; cyclopentyl-Gly-OH; D-allylglycine; D-homocyclohexylalanine; L-1-pyrenylalanine; L-2-aminocaproic acid; L-allylglycine; L-homocyclohexylalanine; and N-(2-hydroxy-4-methoxy-Bzl)-Gly-OH.

Amino acid analogues include analogues of arginine or lysine. Examples of amino acid analogues of arginine and lysine include, but are not limited to, the following: citrulline; L-2-amino-3-guanidinopropionic acid; L-2-amino-3-ureidopropionic acid; L-citrulline; Lys(Me)$_2$-OH; Lys(N$_3$)—OH; Nδ-benzyloxycarbonyl-L-omithine; Nω-nitro-D-arginine; Nω-nitro-L-arginine; α-methyl-ornithine; 2,6-diaminoheptanedioic acid; L-ornithine; (Nδ-1-(4,4-dimethyl-2,6-dioxo-cyclohex-1-ylidene)ethyl)-D-ornithine; (Nδ-1-(4,4-dimethyl-2,6-dioxo-cyclohex-1-ylidene)ethyl)-L-omithine; (Nδ-4-methyltrityl)-D-ornithine; (Nδ-4-methyltrityl)-L-omithine; D-omithine; L-ornithine; Arg(Me)(Pbf)-OH; Arg(Me)$_2$-OH (asymmetrical); Arg(Me)$_2$-OH (symmetrical); Lys(ivDde)-OH; Lys(Me)$_2$-OH.HCl; Lys(Me$_3$)-OH chloride; Nω-nitro-D-arginine; and Nω-nitro-L-arginine.

Amino acid analogues include analogues of aspartic or glutamic acids. Examples of amino acid analogues of aspartic and glutamic acids include, but are not limited to, the following: α-methyl-D-aspartic acid; α-methyl-glutamic acid; α-methyl-L-aspartic acid; γ-methylene-glutamic acid; (N-γ-ethyl)-L-glutamine; [N-α-(4-aminobenzoyl)]-L-glutamic acid; 2,6-diaminopimelic acid; L-α-aminosuberic acid; D-2-aminoadipic acid; D-α-aminosuberic acid; α-aminopimelic acid; iminodiacetic acid; L-2-aminoadipic acid; threo-β-methyl-aspartic acid; γ-carboxy-D-glutamic acid γ,γ-di-t-butyl ester; γ-carboxy-L-glutamic acid γ,γ-di-t-butyl ester; Glu(OAll)-OH; L-Asu(OtBu)-OH; and pyroglutamic acid.

Amino acid analogues include analogues of cysteine and methionine. Examples of amino acid analogues of cysteine and methionine include, but are not limited to, Cys(farnesyl)-OH, Cys(farnesyl)-OMe, α-methyl-methionine, Cys(2-hydroxyethyl)-OH, Cys(3-aminopropyl)-OH, 2-amino-4-(ethylthio)butyric acid, buthionine, buthioninesulfoximine, ethionine, methionine methylsulfonium chloride, selenomethionine, cysteic acid, [2-(4-pyridyl)ethyl]-DL-penicillamine, [2-(4-pyridyl)ethyl]-L-cysteine, 4-methoxybenzyl-D-penicillamine, 4-methoxybenzyl-L-penicillamine, 4-methylbenzyl-D-penicillamine, 4-methylbenzyl-L-penicillamine, benzyl-D-cysteine, benzyl-L-cysteine, benzyl-DL-homocysteine, carbamoyl-L-cysteine, carboxyethyl-L-cysteine, carboxymethyl-L-cysteine, diphenylmethyl-L-cysteine, ethyl-L-cysteine, methyl-L-cysteine, t-butyl-D-cysteine, trityl-L-homocysteine, trityl-D-penicillamine, cystathionine, homocystine, L-homocystine, (2-aminoethyl)-L-cysteine, seleno-L-cystine, cystathionine, Cys(StBu)-OH, and acetamidomethyl-D-penicillamine.

Amino acid analogues include analogues of phenylalanine and tyrosine. Examples of amino acid analogues of phenylalanine and tyrosine include β-methyl-phenylalanine, β-hydroxyphenylalanine, α-methyl-3-methoxy-DL-phenylalanine, α-methyl-D-phenylalanine, α-methyl-L-phenylalanine, 1,2,3,4-tetrahydroisoquinoline-3-carboxylic acid, 2,4-dichloro-phenylalanine, 2-(trifluoromethyl)-D-phenylalanine, 2-(trifluoromethyl)-L-phenylalanine, 2-bromo-D-phenylalanine, 2-bromo-L-phenylalanine, 2-chloro-D-phenylalanine, 2-chloro-L-phenylalanine, 2-cyano-D-phenylalanine, 2-cyano-L-phenylalanine, 2-fluoro-D-phenylalanine, 2-fluoro-L-phenylalanine, 2-methyl-D-phenylalanine, 2-methyl-L-phenylalanine, 2-nitro-D-phenylalanine, 2-nitro-L-phenylalanine, 2;4;5-trihydroxy-phenylalanine, 3,4,5-trifluoro-D-phenylalanine, 3,4,5-trifluoro-L-phenylalanine, 3,4-dichloro-D-phenylalanine, 3,4-dichloro-L-phenylalanine, 3,4-difluoro-D-phenylalanine, 3,4-difluoro-L-phenylalanine, 3,4-dihydroxy-L-phenylalanine, 3,4-dimethoxy-L-phenylalanine, 3,5,3'-triiodo-L-thyronine, 3,5-diiodo-D-tyrosine, 3,5-diiodo-L-tyrosine, 3,5-diiodo-L-thyronine, 3-(trifluoromethyl)-D-phenylalanine, 3-(trifluoromethyl)-L-phenylalanine, 3-amino-L-tyrosine, 3-bromo-D-phenylalanine, 3-bromo-L-phenylalanine, 3-chloro-D-phenylalanine, 3-chloro-L-phenylalanine, 3-chloro-L-tyrosine, 3-cyano-D-phenylalanine, 3-cyano-L-phenylalanine, 3-fluoro-D-phenylalanine, 3-fluoro-L-phenylalanine, 3-fluoro-tyrosine, 3-iodo-D-phenylalanine, 3-iodo-L-phenylalanine, 3-iodo-L-tyrosine, 3-methoxy-L-tyrosine, 3-methyl-D-phenylalanine, 3-methyl-L-phenylalanine, 3-nitro-D-phenylalanine, 3-nitro-L-phenylalanine, 3-nitro-L-tyrosine, 4-(trifluoromethyl)-D-phenylalanine, 4-(trifluoromethyl)-L-phenylalanine, 4-amino-D-phenylalanine, 4-amino-L-phenylalanine, 4-benzoyl-D-phenylalanine, 4-benzoyl-L-phenylalanine, 4-bis(2-chloroethyl)amino-L-phenylalanine, 4-bromo-D-phenylalanine, 4-bromo-L-phenylalanine, 4-chloro-D-phenylalanine, 4-chloro-L-phenylalanine, 4-cyano-D-phenylalanine, 4-cyano-L-phenylalanine, 4-fluoro-D-phenylalanine, 4-fluoro-L-phenylalanine, 4-iodo-D-phenylalanine, 4-iodo-L-phenylalanine, homophenylalanine, thyroxine, 3,3-diphenylalanine, thyronine, ethyl-tyrosine, and methyl-tyrosine.

Amino acid analogues include analogues of proline. Examples of amino acid analogues of proline include, but are not limited to, 3,4-dehydro-proline, 4-fluoro-proline, cis-4-hydroxy-proline, thiazolidine-2-carboxylic acid, and trans-4-fluoro-proline.

Amino acid analogues include analogues of serine and threonine. Examples of amino acid analogues of serine and threonine include, but are not limited to, 3-amino-2-hydroxy-5-methylhexanoic acid, 2-amino-3-hydroxy-4-methylpentanoic acid, 2-amino-3-ethoxybutanoic acid, 2-amino-3-methoxybutanoic acid, 4-amino-3-hydroxy-6-methylheptanoic acid, 2-amino-3-benzyloxypropionic acid, 2-amino-3-benzyloxypropionic acid, 2-amino-3-ethoxypropionic acid, 4-amino-3-hydroxybutanoic acid, and α-methylserine.

Amino acid analogues include analogues of tryptophan. Examples of amino acid analogues of tryptophan include, but are not limited to, the following: α-methyl-tryptophan; β-(3-benzothienyl)-D-alanine; β-(3-benzothienyl)-L-alanine; 1-methyl-tryptophan; 4-methyl-tryptophan; 5-benzyloxy-tryptophan; 5-bromo-tryptophan; 5-chloro-tryptophan; 5-fluoro-tryptophan; 5-hydroxy-tryptophan; 5-hydroxy-L-tryptophan; 5-methoxy-tryptophan; 5-methoxy-L-tryptophan; 5-methyl-tryptophan; 6-bromo-tryptophan; 6-chloro-D-tryptophan; 6-chloro-tryptophan; 6-fluoro-tryptophan; 6-methyl-tryptophan; 7-benzyloxy-tryptophan; 7-bromo-tryptophan; 7-methyl-tryptophan; D-1,2,3,4-tetrahydronorharman-3-carboxylic acid; 6-methoxy-1,2,3,4-tetrahydronorharman-1-carboxylic acid; 7-azatryptophan; L-1,2,3,4-tetrahydro-norharman-3-carboxylic acid; 5-methoxy-2-methyl-tryptophan; and 6-chloro-L-tryptophan.

In some embodiments, amino acid analogues are racemic. In some embodiments, the D isomer of the amino acid analogue is used. In some embodiments, the L isomer of the amino acid analogue is used. In other embodiments, the amino acid analogue comprises chiral centers that are in the R or S configuration. In still other embodiments, the amino group(s) of a β-amino acid analogue is substituted with a protecting group, e.g., tert-butyloxycarbonyl (BOC group), 9-fluorenylmethyloxycarbonyl (FMOC), tosyl, and the like. In yet other embodiments, the carboxylic acid functional group of a β-amino acid analogue is protected, e.g., as its ester derivative. In some embodiments the salt of the amino acid analogue is used.

A "non-essential" amino acid residue is a residue that can be altered from the wild-type sequence of a polypeptide without abolishing or substantially abolishing its essential biological or biochemical activity (e.g., receptor binding or activation). An "essential" amino acid residue is a residue that, when altered from the wild-type sequence of the polypeptide, results in abolishing or substantially abolishing the polypeptide's essential biological or biochemical activity.

A "conservative amino acid substitution" is one in which the amino acid residue is replaced with an amino acid residue having a similar side chain. Families of amino acid residues having similar side chains have been defined in the art. These families include amino acids with basic side chains (e.g., K, R, H), acidic side chains (e.g., D, E), uncharged polar side chains (e.g., G, N, Q, S, T, Y, C), nonpolar side chains (e.g., A, V, L, I, P, F, M, W), beta-branched side chains (e.g., T, V, I) and aromatic side chains (e.g., Y, F, W, H). Thus, a predicted nonessential amino acid residue in a polypeptide, e.g., is replaced with another amino acid residue from the same side chain family. Other examples of acceptable substitutions are substitutions based on isosteric considerations (e.g., norleucine for methionine) or other properties (e.g., 2-thienylalanine for phenylalanine, or 6-Cl-tryptophan for tryptophan).

The term "capping group" refers to the chemical moiety occurring at either the carboxy or amino terminus of the polypeptide chain of the subject peptidomimetic macrocycle. The capping group of a carboxy terminus includes an unmodified carboxylic acid (i.e. —COOH) or a carboxylic acid with a substituent. For example, the carboxy terminus can be substituted with an amino group to yield a carboxamide at the C-terminus. Various substituents include but are not limited to primary, secondary, and tertiary amines, including pegylated secondary amines. Representative secondary amine capping groups for the C-terminus include:

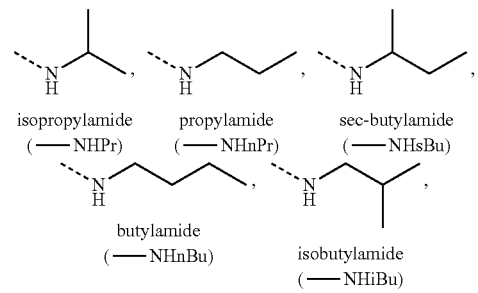

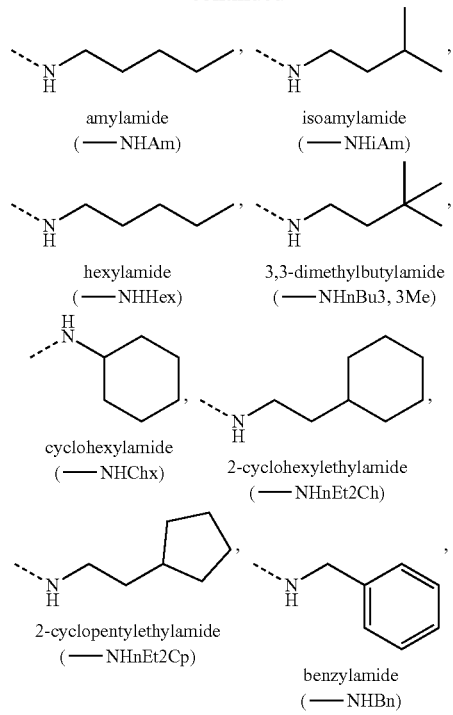
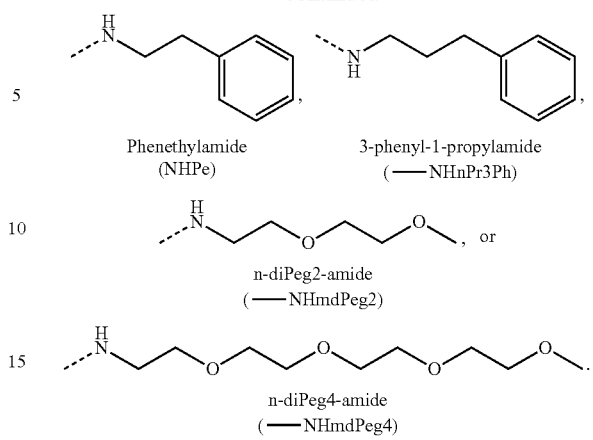

The capping group of an amino terminus includes an unmodified amine (i.e. —NH$_2$) or an amine with a substituent. For example, the amino terminus can be substituted with an acyl group to yield a carboxamide at the N-terminus. Various substituents include but are not limited to substituted acyl groups, including $C_1$-$C_6$ carbonyls, $C_7$-$C_{30}$ carbonyls, and pegylated carbamates. Representative capping groups for the N-terminus include, but are not limited to, 4-FBzl (4-fluoro-benzyl) and the following:

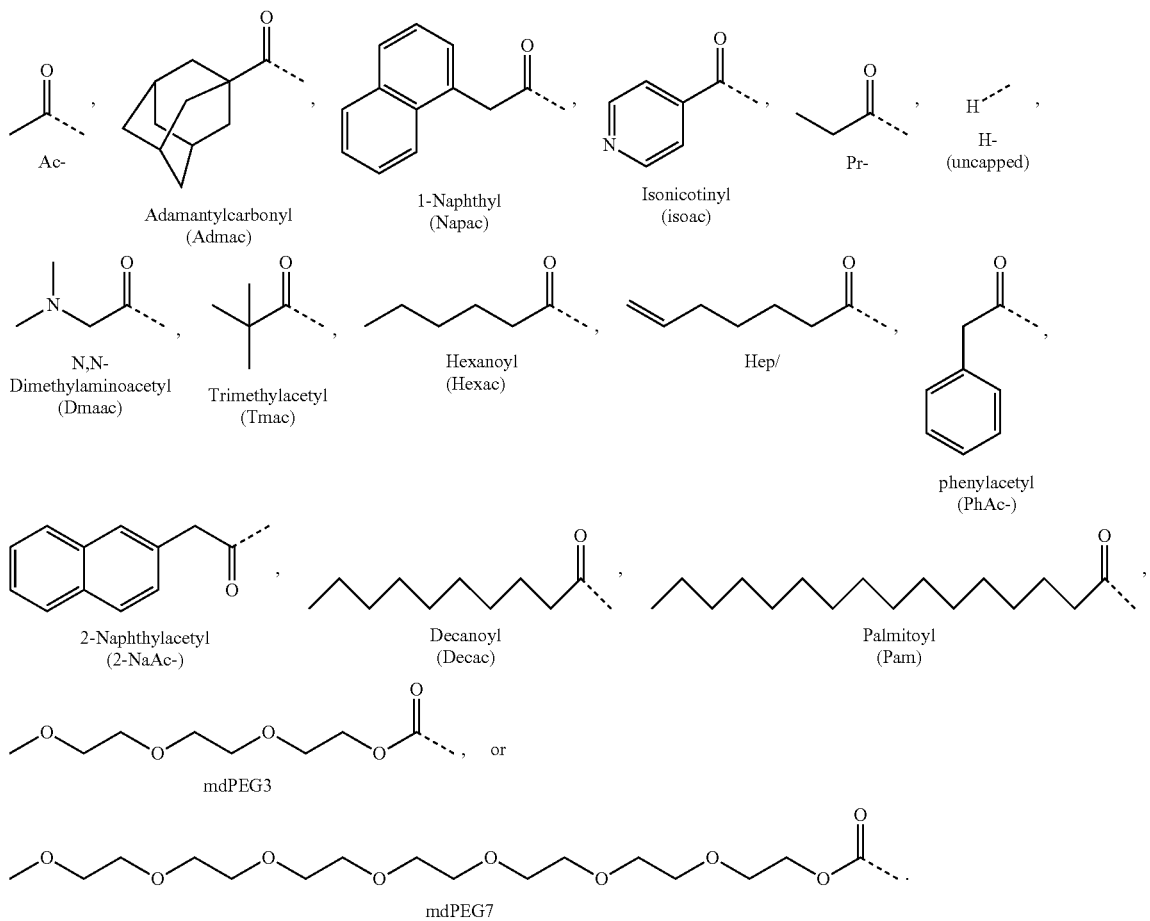

The term "member" as used herein in conjunction with macrocycles or macrocycle-forming linkers refers to the atoms that form or can form the macrocycle, and excludes substituent or side chain atoms. By analogy, cyclodecane, 1,2-difluoro-decane and 1,3-dimethyl cyclodecane are all considered ten-membered macrocycles as the hydrogen or fluoro substituents or methyl side chains do not participate in forming the macrocycle.

The symbol "⫽" when used as part of a molecular structure refers to a single bond or a trans or cis double bond.

The term "amino acid side chain" refers to a moiety attached to the α-carbon (or another backbone atom) in an amino acid. For example, the amino acid side chain for alanine is methyl, the amino acid side chain for phenylalanine is phenylmethyl, the amino acid side chain for cysteine is thiomethyl, the amino acid side chain for aspartate is carboxymethyl, the amino acid side chain for tyrosine is 4-hydroxyphenylmethyl, etc. Other non-naturally-occurring amino acid side chains are also included, for example, those that occur in nature (e.g., an amino acid metabolite) or those that are made synthetically (e.g., an α,α di-substituted amino acid).

The term "α,α di-substituted amino" acid refers to a molecule or moiety containing both an amino group and a carboxyl group bound to a carbon (the α-carbon) that is attached to two natural or non-natural amino acid side chains.

The term "polypeptide" encompasses two or more naturally- or non-naturally-occurring amino acids joined by a covalent bond (e.g., an amide bond). Polypeptides as described herein include full length proteins (e.g., fully processed proteins) as well as shorter amino acid sequences (e.g., fragments of naturally-occurring proteins or synthetic polypeptide fragments).

The term "first C-terminal amino acid" refers to the amino acid which is closest to the C-terminus. The term "second C-terminal amino acid" refers to the amino acid attached at the N-terminus of the first C-terminal amino acid.

The term "macrocyclization reagent" or "macrocycle-forming reagent" as used herein refers to any reagent which can be used to prepare a peptidomimetic macrocycle by mediating the reaction between two reactive groups. Reactive groups can be, for example, an azide and alkyne, in which case macrocyclization reagents include, without limitation, Cu reagents such as reagents which provide a reactive Cu(I) species, such as CuBr, CuI or CuOTf, as well as Cu(II) salts such as $Cu(CO_2CH_3)_2$, $CuSO_4$, and $CuCl_2$ that can be converted in situ to an active Cu(I) reagent by the addition of a reducing agent such as ascorbic acid or sodium ascorbate. Macrocyclization reagents can additionally include, for example, Ru reagents known in the art such as Cp*RuCl$(PPh_3)_2$, [Cp*RuCl]$_4$ or other Ru reagents which can provide a reactive Ru(II) species. In other cases, the reactive groups are terminal olefins. In such embodiments, the macrocyclization reagents or macrocycle-forming reagents are metathesis catalysts including, but not limited to, stabilized, late transition metal carbene complex catalysts such as Group VIII transition metal carbene catalysts. For example, such catalysts are Ru and Os metal centers having a +2 oxidation state, an electron count of 16 and pentacoordinated. In other examples, catalysts have W or Mo centers. In some embodiments, the reactive groups are thiol groups. In some embodiments, the macrocyclization reagent is, for example, a linker functionalized with two thiol-reactive groups such as halogen groups.

The term "halo" or "halogen" refers to fluorine, chlorine, bromine or iodine or a radical thereof.

The term "alkyl" refers to a hydrocarbon chain that is a straight chain or branched chain, containing the indicated number of carbon atoms. For example, $C_1$-$C_{10}$ indicates that the group has from 1 to 10 (inclusive) carbon atoms in it. In the absence of any numerical designation, "alkyl" is a chain (straight or branched) having 1 to 20 (inclusive) carbon atoms.

The term "alkylene" refers to a divalent alkyl (i.e., —R—).

The term "alkenyl" refers to a hydrocarbon chain that is a straight chain or branched chain having one or more carbon-carbon double bonds. The alkenyl moiety contains the indicated number of carbon atoms. For example, $C_2$-$C_{10}$ indicates that the group has from 2 to 10 (inclusive) carbon atoms. The term "lower alkenyl" refers to a $C_2$-$C_6$ alkenyl chain. In the absence of any numerical designation, "alkenyl" is a chain (straight or branched) having 2 to 20 (inclusive) carbon atoms.

The term "alkynyl" refers to a hydrocarbon chain that is a straight chain or branched chain having one or more carbon-carbon triple bonds. The alkynyl moiety contains the indicated number of carbon atoms. For example, $C_2$-$C_{10}$ indicates that the group has from 2 to 10 (inclusive) carbon atoms. The term "lower alkynyl" refers to a $C_2$-$C_6$ alkynyl chain. In the absence of any numerical designation, "alkynyl" is a chain (straight or branched) having 2 to 20 (inclusive) carbon atoms.

The term "aryl" refers to a 6-carbon monocyclic or 10-carbon bicyclic aromatic ring system wherein 0, 1, 2, 3, or 4 atoms of each ring are substituted by a substituent. Examples of aryl groups include phenyl, naphthyl and the like. The term "arylalkoxy" refers to an alkoxy substituted with aryl.

"Arylalkyl" refers to an aryl group, as defined above, wherein one of the aryl group's hydrogen atoms has been replaced with a $C_1$-$C_5$ alkyl group, as defined above. Representative examples of an arylalkyl group include, but are not limited to, 2-methylphenyl, 3-methylphenyl, 4-methylphenyl, 2-ethylphenyl, 3-ethylphenyl, 4-ethylphenyl, 2-propylphenyl, 3-propylphenyl, 4-propylphenyl, 2-butylphenyl, 3-butylphenyl, 4-butylphenyl, 2-pentylphenyl, 3-pentylphenyl, 4-pentylphenyl, 2-isopropylphenyl, 3-isopropylphenyl, 4-isopropylphenyl, 2-isobutylphenyl, 3-isobutylphenyl, 4-isobutylphenyl, 2-sec-butylphenyl, 3-sec-butylphenyl, 4-sec-butylphenyl, 2-t-butylphenyl, 3-t-butylphenyl and 4-t-butylphenyl.

"Arylamido" refers to an aryl group, as defined above, wherein one of the aryl group's hydrogen atoms has been replaced with one or more —C(O)NH$_2$ groups. Representative examples of an arylamido group include 2-C(O)NH$_2$-phenyl, 3-C(O)NH$_2$-phenyl, 4-C(O)NH$_2$-phenyl, 2-C(O)NH$_2$-pyridyl, 3-C(O)NH$_2$-pyridyl, and 4-C(O)NH$_2$-pyridyl.

"Alkylheterocycle" refers to a $C_1$-$C_5$ alkyl group, as defined above, wherein one of the $C_1$-$C_5$ alkyl group's hydrogen atoms has been replaced with a heterocycle. Representative examples of an alkylheterocycle group include, but are not limited to, —CH$_2$CH$_2$-morpholine, —CH$_2$CH$_2$-piperidine, —CH$_2$CH$_2$CH$_2$-morpholine, and —CH$_2$CH$_2$CH$_2$-imidazole.

"Alkylamido" refers to a $C_1$-$C_5$ alkyl group, as defined above, wherein one of the $C_1$-$C_5$ alkyl group's hydrogen atoms has been replaced with a —C(O)NH$_2$ group. Representative examples of an alkylamido group include, but are not limited to, —CH$_2$—C(O)NH$_2$, —CH$_2$CH$_2$—C(O)NH$_2$, —CH$_2$CH$_2$CH$_2$C(O)NH$_2$, —CH$_2$CH$_2$CH$_2$CH$_2$C(O)NH$_2$, —CH$_2$CH$_2$CH$_2$CH$_2$CH$_2$C(O)NH$_2$, —CH$_2$CH(C(O)NH$_2$)CH$_3$, —CH$_2$CH(C(O)NH$_2$)CH$_2$CH$_3$, —CH(C(O)NH$_2$)CH$_2$CH$_3$, —C(CH$_3$)$_2$CH$_2$C(O)NH$_2$, —CH$_2$—CH$_2$—NH—C(O)—CH$_3$, —CH$_2$—CH$_2$—NH—C(O)—CH$_3$—CH$_3$, and —CH$_2$—CH$_2$—NH—C(O)—CH=CH$_2$.

"Alkanol" refers to a C$_1$-C$_5$ alkyl group, as defined above, wherein one of the C$_1$-C$_5$ alkyl group's hydrogen atoms has been replaced with a hydroxyl group. Representative examples of an alkanol group include, but are not limited to, —CH$_2$OH, —CH$_2$CH$_2$OH, —CH$_2$CH$_2$CH$_2$OH, —CH$_2$CH$_2$CH$_2$CH$_2$OH, —CH$_2$CH$_2$CH$_2$ CH$_2$CH$_2$OH, —CH$_2$CH(OH)CH$_3$, —CH$_2$CH(OH)CH$_2$CH$_3$, —CH(OH)CH$_3$ and —C(CH$_3$)$_2$CH$_2$OH.

"Alkylcarboxy" refers to a C$_1$-C$_5$ alkyl group, as defined above, wherein one of the C$_1$-C$_5$ alkyl group's hydrogen atoms has been replaced with a —COOH group. Representative examples of an alkylcarboxy group include, but are not limited to, —CH$_2$COOH, —CH$_2$CH$_2$COOH, —CH$_2$CH$_2$CH$_2$COOH, —CH$_2$CH$_2$CH$_2$CH$_2$COOH, —CH$_2$CH(COOH)CH$_3$, —CH$_2$CH$_2$CH$_2$CH$_2$CH$_2$COOH, —CH$_2$CH(COOH)CH$_2$CH$_3$, —CH(COOH)CH$_2$CH$_3$ and —C(CH$_3$)$_2$CH$_2$COOH.

The term "cycloalkyl" as employed herein includes saturated and partially unsaturated cyclic hydrocarbon groups having 3 to 12 carbons, preferably 3 to 8 carbons, and more preferably 3 to 6 carbons, wherein the cycloalkyl group additionally is optionally substituted. Some cycloalkyl groups include, without limitation, cyclopropyl, cyclobutyl, cyclopentyl, cyclopentenyl, cyclohexyl, cyclohexenyl, cycloheptyl, and cyclooctyl.

The term "heteroaryl" refers to an aromatic 5-8 membered monocyclic, 8-12 membered bicyclic, or 11-14 membered tricyclic ring system having 1-3 heteroatoms if monocyclic, 1-6 heteroatoms if bicyclic, or 1-9 heteroatoms if tricyclic, said heteroatoms selected from O, N, or S (e.g., carbon atoms and 1-3, 1-6, or 1-9 heteroatoms of O, N, or S if monocyclic, bicyclic, or tricyclic, respectively), wherein 0, 1, 2, 3, or 4 atoms of each ring are substituted by a substituent. Examples of heteroaryl groups include pyridyl, furyl or furanyl, imidazolyl, benzimidazolyl, pyrimidinyl, thiophenyl or thienyl, quinolinyl, indolyl, thiazolyl, and the like.

The term "heteroarylalkyl" or the term "heteroaralkyl" refers to an alkyl substituted with a heteroaryl. The term "heteroarylalkoxy" refers to an alkoxy substituted with heteroaryl.

The term "heterocyclyl" refers to a nonaromatic 5-8 membered monocyclic, 8-12 membered bicyclic, or 11-14 membered tricyclic ring system having 1-3 heteroatoms if monocyclic, 1-6 heteroatoms if bicyclic, or 1-9 heteroatoms if tricyclic, said heteroatoms selected from O, N, or S (e.g., carbon atoms and 1-3, 1-6, or 1-9 heteroatoms of O, N, or S if monocyclic, bicyclic, or tricyclic, respectively), wherein 0, 1, 2 or 3 atoms of each ring are substituted by a substituent. Examples of heterocyclyl groups include piperazinyl, pyrrolidinyl, dioxanyl, morpholinyl, tetrahydrofuranyl, and the like.

The term "substituent" refers to a group replacing a second atom or group such as a hydrogen atom on any molecule, compound or moiety. Suitable substituents include, without limitation, halo, hydroxy, mercapto, oxo, nitro, haloalkyl, alkyl, alkaryl, aryl, aralkyl, alkoxy, thioalkoxy, aryloxy, amino, alkoxycarbonyl, amido, carboxy, alkanesulfonyl, alkylcarbonyl, and cyano groups.

In some embodiments, the compounds disclosed herein contain one or more asymmetric centers and thus occur as racemates and racemic mixtures, single enantiomers, individual diastereomers and diastereomeric mixtures. All such isomeric forms of these compounds are included unless expressly provided otherwise. In some embodiments, the compounds disclosed herein are also represented in multiple tautomeric forms, in such instances, the compounds include all tautomeric forms of the compounds described herein (e.g., if alkylation of a ring system results in alkylation at multiple sites, the invention includes all such reaction products). All such isomeric forms of such compounds are included unless expressly provided otherwise. All crystal forms of the compounds described herein are included unless expressly provided otherwise.

As used herein, the terms "increase" and "decrease" mean, respectively, to cause a statistically significantly (i.e., p<0.1) increase or decrease of at least 5%.

As used herein, the recitation of a numerical range for a variable is intended to convey that the variable is equal to any of the values within that range. Thus, for a variable which is inherently discrete, the variable is equal to any integer value within the numerical range, including the end-points of the range. Similarly, for a variable which is inherently continuous, the variable is equal to any real value within the numerical range, including the end-points of the range. As an example, and without limitation, a variable which is described as having values between 0 and 2 takes the values 0, 1 or 2 if the variable is inherently discrete, and takes the values 0.0, 0.1, 0.01, 0.001, or any other real values ≥0 and ≤2 if the variable is inherently continuous.

As used herein, unless specifically indicated otherwise, the word "or" is used in the inclusive sense of "and/or" and not the exclusive sense of "either/or".

The term "on average" represents the mean value derived from performing at least three independent replicates for each data point.

The term "biological activity" encompasses structural and functional properties of a macrocycle. Biological activity is, for example, structural stability, alpha-helicity, affinity for a target, resistance to proteolytic degradation, cell penetrability, intracellular stability, in vivo stability, or any combination thereof.

The term "binding affinity" refers to the strength of a binding interaction, for example between a peptidomimetic macrocycle and a target. Binding affinity can be expressed, for example, as equilibrium dissociation constant ("K$_D$"), which is expressed in units which are a measure of concentration (e.g. M, mM, µM, nM etc). Numerically, binding affinity and K$_D$ values vary inversely, such that a lower binding affinity corresponds to a higher K$_D$ value, while a higher binding affinity corresponds to a lower K$_D$ value. Where high binding affinity is desirable, "improved" binding affinity refers to higher binding affinity and therefore lower K$_D$ values.

As used herein, the term "treatment" is defined as the application or administration of a therapeutic agent to a patient, or application or administration of a therapeutic agent to an isolated tissue or cell line from a patient, who has a disease, a symptom of disease or a predisposition toward a disease, with the purpose to cure, heal, alleviate, relieve, alter, remedy, ameliorate, improve or affect the disease, the symptoms of disease or the predisposition toward disease.

The terms "combination therapy" or "combined treatment" or in "combination" as used herein denotes any form of concurrent or parallel treatment with at least two distinct therapeutic agents.

The term "in vitro efficacy" refers to the extent to which a test compound, such as a peptidomimetic macrocycle, produces a beneficial result in an in vitro test system or assay. In vitro efficacy can be measured, for example, as an "$IC_{50}$" or "$EC_{50}$" value, which represents the concentration of the test compound which produces 50% of the maximal effect in the test system.

The term "ratio of in vitro efficacies" or "in vitro efficacy ratio" refers to the ratio of $IC_{50}$ or $EC_{50}$ values from a first assay (the numerator) versus a second assay (the denominator). Consequently, an improved in vitro efficacy ratio for Assay 1 versus Assay 2 refers to a lower value for the ratio expressed as $IC_{50}$ (Assay 1)/$IC_{50}$ (Assay 2) or alternatively as $EC_{50}$ (Assay 1)/$EC_{50}$ (Assay 2). This concept can also be characterized as "improved selectivity" in Assay 1 versus Assay 2, which can be due either to a decrease in the $IC_{50}$ or $EC_{50}$ value for Target 1 or an increase in the value for the $IC_{50}$ or $EC_{50}$ value for Target 2.

As used in the present application, "biological sample" means any fluid or other material derived from the body of a normal or diseased subject, such as blood, serum, plasma, lymph, urine, saliva, tears, cerebrospinal fluid, milk, amniotic fluid, bile, ascites fluid, pus, and the like. Also included within the meaning of the term "biological sample" is an organ or tissue extract and culture fluid in which any cells or tissue preparation from a subject has been incubated. The biological samples can be any samples from which genetic material can be obtained. Biological samples can also include solid or liquid cancer cell samples or specimens. The cancer cell sample can be a cancer cell tissue sample. In some embodiments, the cancer cell tissue sample can obtained from surgically excised tissue. Exemplary sources of biological samples include fine needle aspiration, core needle biopsy, vacuum assisted biopsy, incisional biopsy, excisional biopsy, punch biopsy, shave biopsy or skin biopsy. In some cases, the biological samples comprise fine needle aspiration samples. In some embodiments, the biological samples comprise tissue samples, including, for example, excisional biopsy, incisional biopsy, or other biopsy. The biological samples can comprise a mixture of two or more sources; for example, fine needle aspirates and tissue samples. Tissue samples and cellular samples can also be obtained without invasive surgery, for example by punctuating the chest wall or the abdominal wall or from masses of breast, thyroid or other sites with a fine needle and withdrawing cellular material (fine needle aspiration biopsy). In some embodiments, a biological sample is a bone marrow aspirate sample. A biological sample can be obtained by methods known in the art such as the biopsy methods provided herein, swabbing, scraping, phlebotomy, or any other suitable method.

The term "dose-limiting toxicity (DLT)" is defined as any Grade ≥3 adverse effect (AE) that is considered to be possibly, probably, or definitely related to a study drug, with the following exceptions: (1) for fatigue, nausea, emesis, diarrhea or mucositis, only Grade ≥3 AE that do not respond within 48 hours to standard supportive/pharmacological treatment are considered DLT; (2) for electrolyte imbalances, only Grade ≥3 AE that do not respond to correction within 24 hours are considered DLT; (3) for infusion reactions, only a Grade 3 reaction which caused hospitalization or Grade 4 are considered a DLT. In addition, specific hematologic DLTs are defined as: Thrombocytopenia—Grade 4 of any duration, Grade 3 for ≥7 days, or Grade 3 associated with clinically significant bleeding; and Neutropenia—Grade 4 for ≥3 days, or any Grade ≥3 febrile neutropenia. The criteria are used to make individual patient determinations regarding dose reductions, interruptions or discontinuation throughout the course of the trial, but DLTs occurring during Cycle 1 are used to inform safety and tolerability assessments for dose escalation decisions.

The term "maximum tolerated dose (MTD)" is defined as the dose at which ≤1 of 6 patients experiences a treatment-related toxicity that qualifies as a DLT, with the next higher dose having ≥2 of up to 6 patients experiencing a DLT. The MTD is not be established until all patients enrolled in the cohort have completed Cycle 1, discontinued treatment or had a dose reduction. Previously established tolerability of a dose level are reevaluated if toxicities that would have been DLTs in Cycle 1 are observed in later cycles.

The term "optimal biological dose (OBD)" is derived from the evaluation of available safety, PK, PD, and preliminary efficacy information of a drug.

The term "complete response (CR)" in target lesions refers to the disappearance of all target lesions. Any pathological lymph nodes (whether target or non-target) must have reduction in short axis to <10 mm. The term "complete response (CR)" in non-target lesions refers to the disappearance of all non-target lesions and normalization of tumor marker levels. All lymph nodes must be non-pathological in size (<10 mm short axis).

The term "partial response (PR)" in target lesions refers to at least a 30% decrease in the sum of diameters of target lesions, taking as reference the baseline sum diameters.

The term "progressive disease (PD)" in target lesions refers to at least a 20% increase in the sum of diameters of target lesions, taking as reference the smallest sum on study (including the baseline sum if the baseline sum is the smallest sum). In addition to the relative increase of 20%, the sum must also demonstrate an absolute increase of at least 5 mm. The appearance of one or more new lesions is also considered progression. The term PD in non-target lesions refers to the unequivocal progression of existing non-target lesions (The appearance of one or more new lesions is also considered progression). To achieve 'unequivocal progression' on the basis of the non-target disease, there must be an overall level of substantial worsening in non-target disease such that, even in the presence of SD or PR in target disease, the overall tumor burden has increased sufficiently to merit discontinuation.

The term "stable disease (SD)" in target lesions refers to neither sufficient shrinkage to qualify for PR nor sufficient increase to qualify for PD, taking as reference the smallest sum diameters while on the study.

The terms non-CR or non-PD refers to the persistence of one or more non-target lesion(s) or the maintenance of tumor marker levels above normal limits.

The term "solid tumor" or "solid cancer" as used herein refers to tumors that usually do not contain cysts or liquid areas. Solid tumors as used herein include sarcomas, carcinomas and lymphomas. In various embodiments, leukemia (cancer of blood) is not solid tumor.

Solid tumor cancers that can be treated by the methods provided herein include, but are not limited to, sarcomas, carcinomas, and lymphomas. In specific embodiments, solid tumors that can be treated in accordance with the methods described include, but are not limited to, cancer of the breast, liver, neuroblastoma, head, neck, eye, mouth, throat, esophagus, esophagus, chest, bone, lung, kidney, colon, rectum or other gastrointestinal tract organs, stomach, spleen, skeletal muscle, subcutaneous tissue, prostate, breast, ovaries, testicles or other reproductive organs, skin, thyroid, blood, lymph nodes, kidney, liver, pancreas, and brain or central nervous system. Solid tumors that can be treated by the instant methods include tumors and/or metastasis (wherever located) other than lymphatic cancer, for example brain and other central nervous system tumors (including but not limited to tumors of the meninges, brain, spinal cord, cranial nerves and other parts of central nervous system, e.g. glioblastomas or medulla blastemas); head and/or neck cancer; breast tumors; circulatory system tumors (including but not limited to heart, mediastinum and pleura, and other intrathoracic organs, vascular tumors and tumor-associated vascular tissue); excretory system tumors (including but not limited to tumors of kidney, renal pelvis, ureter, bladder, other and unspecified urinary organs); gastrointestinal tract tumors (including but not limited to tumors of the esophagus, stomach, small intestine, colon, colorectal, rectosigmoid junction, rectum, anus and anal canal, tumors involving the liver and intrahepatic bile ducts, gall bladder, other and unspecified parts of biliary tract, pancreas, other and digestive organs); oral cavity tumors (including but not limited to tumors of lip, tongue, gum, floor of mouth, palate, and other parts of mouth, parotid gland, and other parts of the salivary glands, tonsil, oropharynx, nasopharynx, pyriform sinus, hypopharynx, and other sites in the lip, oral cavity and pharynx); reproductive system tumors (including but not limited to tumors of vulva, vagina, Cervix uteri, Corpus uteri, uterus, ovary, and other sites associated with female genital organs, placenta, penis, prostate, testis, and other sites associated with male genital organs); respiratory tract tumors (including but not limited to tumors of nasal cavity and middle ear, accessory sinuses, larynx, trachea, bronchus and lung, e.g. small cell lung cancer or non-small cell lung cancer); skeletal system tumors (including but not limited to tumors of bone and articular cartilage of limbs, bone articular cartilage and other sites); skin tumors (including but not limited to malignant melanoma of the skin, non-melanoma skin cancer, basal cell carcinoma of skin, squamous cell carcinoma of skin, mesothelioma, Kaposi's sarcoma); and tumors involving other tissues including peripheral nerves and autonomic nervous system, connective and soft tissue, retroperitoneum and peritoneum, eye and adnexa, thyroid, adrenal gland and other endocrine glands and related structures, secondary and unspecified malignant neoplasm of lymph nodes, secondary malignant neoplasm of respiratory and digestive systems and secondary malignant neoplasm of other sites.

In some examples, the solid tumor treated by the methods of the instant disclosure is pancreatic cancer, bladder cancer, colon cancer, liver cancer, colorectal cancer (colon cancer or rectal cancer), breast cancer, prostate cancer, renal cancer, hepatocellular cancer, lung cancer, ovarian cancer, cervical cancer, gastric cancer, esophageal cancer, head and neck cancer, melanoma, neuroendocrine cancers, CNS cancers, brain tumors, bone cancer, skin cancer, ocular tumor, choriocarcinoma (tumor of the placenta), sarcoma or soft tissue cancer.

In some examples, the solid tumor to be treated by the methods of the instant disclosure is selected bladder cancer, bone cancer, breast cancer, cervical cancer, CNS cancer, colon cancer, ocular tumor, renal cancer, liver cancer, lung cancer, pancreatic cancer, choriocarcinoma (tumor of the placenta), prostate cancer, sarcoma, skin cancer, soft tissue cancer or gastric cancer.

In some examples, the solid tumor treated by the methods of the instant disclosure is breast cancer. Non limiting examples of breast cancer that can be treated by the instant methods include ductal carcinoma in situ (DCIS or intraductal carcinoma), lobular carcinoma in situ (LCIS), invasive (or infiltrating) ductal carcinoma, invasive (or infiltrating) lobular carcinoma, inflammatory breast cancer, triple-negative breast cancer, paget disease of the nipple, phyllodes tumor (phylloides tumor or cystosarcoma phyllodes), angiosarcoma, adenoid cystic (or adenocystic) carcinoma, low-grade adenosquamous carcinoma, medullary carcinoma, papillary carcinoma, tubular carcinoma, metaplastic carcinoma, micropapillary carcinoma, and mixed carcinoma.

In some examples, the solid tumor treated by the methods of the instant disclosure is bone cancer. Non limiting examples of bone cancer that can be treated by the instant methods include osteosarcoma, chondrosarcoma, the Ewing Sarcoma Family of Tumors (ESFTs).

In some examples, the solid tumor treated by the methods of the instant disclosure is skin cancer. Non limiting examples of skin cancer that can be treated by the instant methods include melanoma, basal cell skin cancer, and squamous cell skin cancer.

In some examples, the solid tumor treated by the methods of the instant disclosure is ocular tumor. Non limiting examples of ocular tumor that can be treated by the methods of the instant disclosure include ocular tumor is choroidal nevus, choroidal melanoma, choroidal metastasis, choroidal hemangioma, choroidal osteoma, iris melanoma, uveal melanoma, intraocular lymphoma, melanocytoma, metastasis retinal capillary hemangiomas, congenital hypertrophy of the RPE, RPE adenoma or retinoblastoma.

In some embodiments solid tumors treated by the methods disclosed herein exclude cancers that are known to be associated with HPV (Human papillomavirus). The excluded group includes HPV positive cervical cancer, HPV positive anal cancer, and HPV head and neck cancers, such as oropharyngeal cancers.

The term "liquid cancer" as used herein refers to cancer cells that are present in body fluids, such as blood, lymph and bone marrow. Liquid cancers include leukemia, myeloma and liquid lymphomas. Liquid lymphomas include lymphomas that contain cysts or liquid areas. Liquid cancers as used herein do not include solid tumors, such as sarcomas and carcinomas or solid lymphomas that do not contain cysts or liquid areas.

Liquid cancer cancers that can be treated by the methods provided herein include, but are not limited to, leukemias, myelomas, and liquid lymphomas. In specific embodiments, liquid cancers that can be treated in accordance with the methods described include, but are not limited to, liquid lymphomas, lekemias, and myelomas. Exemplary liquid lymphomas and leukemias that can be treated in accordance with the methods described include, but are not limited to, chronic lymphocytic leukemia/small lymphocytic lymphoma, B-cell prolymphocytic leukemia, lymphoplasmacytic lymphoma (such as waldenström macroglobulinemia), splenic marginal zone lymphoma, plasma cell myeloma, plasmacytoma, monoclonal immunoglobulin deposition diseases, heavy chain diseases, extranodal marginal zone B cell lymphoma, also called malt lymphoma, nodal marginal zone B cell lymphoma (nmzl), follicular lymphoma, mantle cell lymphoma, diffuse large B cell lymphoma, mediastinal (thymic) large B cell lymphoma, intravascular large B cell lymphoma, primary effusion lymphoma, burkitt lymphoma/leukemia, T cell prolymphocytic leukemia, T cell large granular lymphocytic leukemia, aggressive NK cell leukemia, adult T cell leukemia/lymphoma, extranodal NK/T cell lymphoma, nasal type, enteropathy-type T cell lymphoma, hepatosplenic T cell lymphoma, blastic NK cell lymphoma, mycosis fungoides/sezary syndrome, primary cutaneous CD30-positive T cell lymphoproliferative disorders, primary cutaneous anaplastic large cell lymphoma, lymphomatoid papulosis, angioimmunoblastic T cell lymphoma, peripheral T cell lymphoma, unspecified, anaplastic large cell lymphoma, classical Hodgkin lymphomas (nodular sclerosis, mixed cellularity, lymphocyte-rich, lymphocyte depleted or not depleted), and nodular lymphocyte-predominant Hodgkin lymphoma.

Examples of liquid cancers include cancers involving hyperplastic/neoplastic cells of hematopoietic origin, e.g., arising from myeloid, lymphoid or erythroid lineages, or precursor cells thereof. Exemplary disorders include: acute leukemias, e.g., erythroblastic leukemia and acute megakaryoblastic leukemia. Additional exemplary myeloid disorders include, but are not limited to, acute promyeloid leukemia (APML), acute myelogenous leukemia (AML) and chronic myelogenous leukemia (CML); lymphoid malignancies include, but are not limited to acute lymphoblastic leukemia (ALL) which includes B-lineage ALL and T-lineage ALL, chronic lymphocytic leukemia (CLL), prolymphocytic leukemia (PLL), multiple mylenoma, hairy cell leukemia (HLL) and Waldenstrom's macroglobulinemia (WM). Additional forms of malignant liquid lymphomas include, but are not limited to non-Hodgkin lymphoma and variants thereof, adult T cell leukemia/lymphoma (ATL), cutaneous T-cell lymphoma (CTCL), peripheral T-cell lymphoma (PTCL), large granular lymphocytic leukemia (LGF), Hodgkin's disease and Reed-Sternberg disease. For example, liquid cancers include, but are not limited to, acute lymphocytic leukemia (ALL); T-cell acute lymphocytic leukemia (T-ALL); anaplastic large cell lymphoma (ALCL); chronic myelogenous leukemia (CML); acute myeloid leukemia (AML); chronic lymphocytic leukemia (CLL); B-cell chronic lymphocytic leukemia (B-CLL); diffuse large B-cell lymphomas (DLBCL); hyper eosinophilia/chronic eosinophilia; and Burkitt's lymphoma.

In some embodiments, the cancer comprises an acute lymphoblastic leukemia; acute myeloid leukemia; AIDS-related cancers; AIDS-related lymphoma; chronic lymphocytic leukemia; chronic myelogenous leukemia; chronic myeloproliferative disorders; adult T cell leukemia/lymphoma (ATL), cutaneous T-cell lymphoma (CTCL), peripheral T-cell lymphoma (PTCL); Hodgkin lymphoma; multiple myeloma; multiple myeloma/plasma cell neoplasm; Non-Hodgkin lymphoma; or primary central nervous system (CNS) lymphoma. In various embodiments, the liquid cancer can be B-cell chronic lymphocytic leukemia, B-cell lymphoma-DLBCL, B-cell lymphoma-DLBCL-germinal center-like, B-cell lymphoma-DLBCL-activated B-cell-like, or Burkitt's lymphoma.

In some embodiments, a subject treated in accordance with the methods provided herein is a human who has or is diagnosed with cancer lacking p53 deactivating mutation and/or expressing wild type p53. In some embodiments, a subject treated for cancer in accordance with the methods provided herein is a human predisposed or susceptible to cancer lacking p53 deactivating mutation and/or expressing wild type p53. In some embodiments, a subject treated for cancer in accordance with the methods provided herein is a human at risk of developing cancer lacking p53 deactivating mutation and/or expressing wild type p53. A p53 deactivating mutation in some example can be a mutation in DNA-binding domain of the p53 protein. In some examples the p53 deactivating mutation can be a missense mutation. In various examples, the cancer can be determined to lack one or more p53 deactivating mutations selected from mutations at one or more of residues R175, G245, R248, R249, R273, and R282. The lack of p53 deactivating mutation and/or the presence of wild type p53 in the cancer can be determined by any suitable method known in art, for example by sequencing, array based testing, RNA analysis and amplifications methods like PCR.

In certain embodiments, the human subject is refractory and/or intolerant to one or more other standard treatment of the cancer known in art. In some embodiments, the human subject has had at least one unsuccessful prior treatment and/or therapy of the cancer.

In some embodiments, a subject treated for tumor in accordance with the methods provided herein is a human, who has or is diagnosed with a tumor. In other embodiments, a subject treated for tumor in accordance with the methods provided herein is a human, predisposed or susceptible to a tumor. In some embodiments, a subject treated for tumor in accordance with the methods provided herein is a human, at risk of developing a tumor.

In some embodiments, a subject treated for tumor in accordance with the methods provided herein is a human, who has or is diagnosed with a tumor, determined to lack a p53 deactivating mutation and/or expressing wild type p53. In other embodiments, a subject treated for tumor in accordance with the methods provided herein is a human, predisposed or susceptible to a tumor, determined to lack a p53 deactivating mutation and/or expressing wild type p53. In some embodiments, a subject treated for tumor in accordance with the methods provided herein is a human, at risk of developing a tumor, determined to lack a p53 deactivating mutation and/or expressing wild type p53. A p53 deactivating mutation, as used herein is any mutation that leads to loss of (or a decrease in) the in vitro apoptotic activity of p53.

In some embodiments, the subject treated for a tumor in accordance with the methods provided herein is a human, who has or is diagnosed with a tumor, determined to have a p53 gain of function mutation. In other embodiments, a subject treated for tumor in accordance with the methods provided herein is a human, predisposed or susceptible to a tumor, determined to have a p53 gain of function mutation. In some embodiments, a subject treated for tumor in accordance with the methods provided herein is a human, at risk of developing a tumor, determined to have a p53 gain of function mutation. A p53 gain of function mutation, as used herein is any mutation such that the mutant p53 exerts oncogenic functions beyond their negative domination over the wild-type p53 tumor suppressor functions. The p53 gain of function mutant protein mat exhibit new activities that can contribute actively to various stages of tumor progression and to increased resistance to anticancer treatments. Accordingly, in some embodiments, a subject with a tumor in accordance with the composition as provided herein is a human who has or is diagnosed with a tumor that is determined to have a p53 gain of function mutation.

In some embodiments, the subject treated for tumor in accordance with the methods provided herein is a human, who has or is diagnosed with a tumor that is not p53 negative. In other embodiments, a subject treated for tumor in accordance with the methods provided herein is a human, predisposed or susceptible to a tumor that is not p53 negative. In some embodiments, a subject treated for tumor in accordance with the methods provided herein is a human, at risk of developing a tumor that is not p53 negative.

In some embodiments, the subject treated for tumor in accordance with the methods provided herein is a human, who has or is diagnosed with a tumor that expresses p53 with partial loss of function mutation. In other embodiments, a subject treated for tumor in accordance with the methods provided herein is a human, predisposed or susceptible to a tumor that expresses p53 with partial loss of function mutation. In some embodiments, a subject treated for tumor in accordance with the methods provided herein is a human, at risk of developing a tumor that expresses p53 with partial loss of function mutation. As used herein "a partial loss of p53 function" mutation means that the mutant p53 exhibits some level of function of normal p53, but to a lesser or slower extent. For example, a partial loss of p53 function can mean that the cells become arrested in cell division to a lesser or slower extent.

In some embodiments, the subject treated for tumor in accordance with the methods provided herein is a human, who has or is diagnosed with a tumor that expresses p53 with a copy loss mutation and a deactivating mutation. In other embodiments, a subject treated for tumor in accordance with the methods provided herein is a human, predisposed or susceptible to a tumor that expresses p53 with a copy loss mutation and a deactivating mutation. In some embodiments, a subject treated for tumor in accordance with the methods provided herein is a human, at risk of developing a tumor that expresses p53 with a copy loss mutation and a deactivating mutation.

In some embodiments, the subject treated for tumor in accordance with the methods provided herein is a human, who has or is diagnosed with a tumor that expresses p53 with a copy loss mutation. In other embodiments, a subject treated for tumor in accordance with the methods provided herein is a human, predisposed or susceptible to a tumor that expresses p53 with a copy loss mutation. In some embodiments, a subject treated for tumor in accordance with the methods provided herein is a human, at risk of developing a tumor that expresses p53 with a copy loss mutation.

In some embodiments, the subject treated for tumor in accordance with the methods provided herein is a human, who has or is diagnosed with a tumor that expresses p53 with one or more silent mutations. In other embodiments, a subject treated for tumor in accordance with the methods provided herein is a human, predisposed or susceptible to a tumor that expresses p53 with one or more silent mutations. In some embodiments, a subject treated for tumor in accordance with the methods provided herein is a human, at risk of developing a tumor that expresses p53 with one or more silent mutations. Silent mutations as used herein are mutations which cause no change in the encoded p53 amino acid sequence.

In some embodiments, a subject treated for tumor in accordance with the methods provided herein is a human, who has or is diagnosed with a tumor, determined to lack a dominant p53 deactivating mutation. Dominant p53 deactivating mutation or dominant negative mutation, as used herein, is a mutation wherein the mutated p53 inhibits or disrupt the activity of the wild-type p53 gene.

Peptidomimetic Macrocycles

In some embodiments, a peptidomimetic macrocycle has the Formula (I):

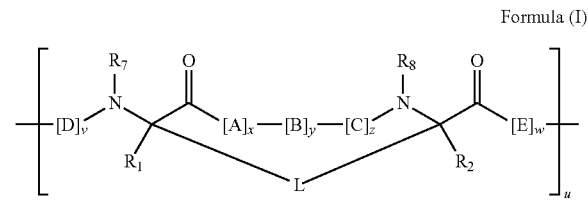

Formula (I)

wherein:
each A, C, D, and E is independently a natural or non-natural amino acid or an amino acid analog, and each terminal D and E independently optionally includes a capping group;
each B is independently a natural or non-natural amino acid, an amino acid analog, O,

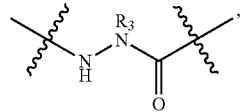

[—NH-$L_3$-CO—], [—NH-$L_3$-$SO_2$—], or [—NH-$L_3$-];
each $R_1$ and $R_2$ is independently —H, alkyl, alkenyl, alkynyl, arylalkyl, cycloalkyl, cycloalkylalkyl, heteroalkyl, or heterocycloalkyl, unsubstituted or substituted with halo-, or at least one of $R_1$ and $R_2$ forms a macrocycle-forming linker L' connected to the alpha position of one of said D or E amino acids;
each $R_3$ is independently hydrogen, alkyl, alkenyl, alkynyl, arylalkyl, heteroalkyl, cycloalkyl, heterocycloalkyl, cycloalkylalkyl, aryl, or heteroaryl, optionally substituted with $R_5$;
each L and L' is independently a macrocycle-forming linker of the formula -$L_1$-$L_2$-;
each $L_1$, $L_2$, and $L_3$ is independently alkylene, alkenylene, alkynylene, heteroalkylene, cycloalkylene, heterocycloalkylene, arylene, heteroarylene, or [—$R_4$—K—$R_4$-]$_n$, each being optionally substituted with $R_5$;
each $R_4$ is independently alkylene, alkenylene, alkynylene, heteroalkylene, cycloalkylene, heterocycloalkylene, arylene, or heteroarylene;
each K is independently O, S, SO, $SO_2$, CO, $CO_2$, or $CONR_3$;
each $R_5$ is independently halogen, alkyl, —$OR_6$, —N($R_6$)$_2$, —$SR_6$, —$SOR_6$, —$SO_2R_6$, —$CO_2R_6$, a fluorescent moiety, a radioisotope or a therapeutic agent;
each $R_6$ is independently —H, alkyl, alkenyl, alkynyl, arylalkyl, cycloalkylalkyl, heterocycloalkyl, a fluorescent moiety, a radioisotope or a therapeutic agent;
each $R_7$ is independently —H, alkyl, alkenyl, alkynyl, arylalkyl, cycloalkyl, heteroalkyl, cycloalkylalkyl, heterocycloalkyl, aryl, or heteroaryl, optionally substituted with $R_5$, or part of a cyclic structure with a D residue;
each $R_8$ is independently —H, alkyl, alkenyl, alkynyl, arylalkyl, cycloalkyl, heteroalkyl, cycloalkylalkyl, heterocycloalkyl, aryl, or heteroaryl, optionally substituted with $R_5$, or part of a cyclic structure with an E residue;
each v and w is independently an integer from 1-1000, for example 1-500, 1-200, 1-100, 1-50, 1-30, 1-20, or 1-10;
u is an integer from 1-10, for example 1-5, 1-3 or 1-2;
each x, y, and z is independently an integer from 0-10, for example the sum of x+y+z is 2, 3, or 6; and
n is an integer from 1-5.

In some embodiments, v and w are integers from 1-30. In some embodiments, w is an integer from 3-1000, for example 3-500, 3-200, 3-100, 3-50, 3-30, 3-20, or 3-10. In some embodiments, the sum of x+y+z is 3 or 6. In some embodiments, the sum of x+y+z is 3. In other embodiments, the sum of x+y+z is 6.

In some embodiments, w is an integer from 3-10, for example 3-6, 3-8, 6-8, or 6-10. In some embodiments, w is 3. In other embodiments, w is 6. In some embodiments, v is an integer from 1-1000, for example 1-500, 1-200, 1-100, 1-50, 1-30, 1-20, or 1-10. In some embodiments, v is 2.

In an embodiment of any of the Formulas described herein, $L_1$ and $L_2$, either alone or in combination, do not form a triazole or a thioether.

In one example, at least one of $R_1$ and $R_2$ is alkyl that is unsubstituted or substituted with halo-. In another example, both $R_1$ and $R_2$ are independently alkyl that is unsubstituted or substituted with halo-. In some embodiments, at least one of $R_1$ and $R_2$ is methyl. In other embodiments, $R_1$ and $R_2$ are methyl.

In some embodiments, x+y+z is at least 3. In other embodiments, x+y+z is 1, 2, 3, 4, 5, 6, 7, 8, 9 or 10. In some embodiments, the sum of x+y+z is 3 or 6. In some embodiments, the sum of x+y+z is 3. In other embodiments, the sum of x+y+z is 6. Each occurrence of A, B, C, D or E in a macrocycle or macrocycle precursor is independently selected. For example, a sequence represented by the formula $[A]_x$, when x is 3, encompasses embodiments wherein the amino acids are not identical, e.g. Gln-Asp-Ala as well as embodiments wherein the amino acids are identical, e.g. Gln-Gln-Gln. This applies for any value of x, y, or z in the indicated ranges. Similarly, when u is greater than 1, each compound can encompass peptidomimetic macrocycles which are the same or different. For example, a compound can comprise peptidomimetic macrocycles comprising different linker lengths or chemical compositions.

In some embodiments, the peptidomimetic macrocycle comprises a secondary structure which is an α-helix and $R_8$ is —H, allowing for intra-helical hydrogen bonding. In some embodiments, at least one of A, B, C, D or E is an α,α-disubstituted amino acid. In one example, B is an α,α-disubstituted amino acid. For instance, at least one of A, B, C, D or E is 2-aminoisobutyric acid. In other embodiments, at least one of A, B, C, D or E is

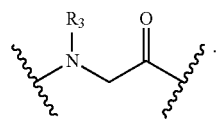

In other embodiments, the length of the macrocycle-forming linker L as measured from a first Cα to a second Cα is selected to stabilize a desired secondary peptide structure, such as an α-helix formed by residues of the peptidomimetic macrocycle including, but not necessarily limited to, those between the first Cα to a second Cα.

In some embodiments, peptidomimetic macrocycles are also provided of the formula:

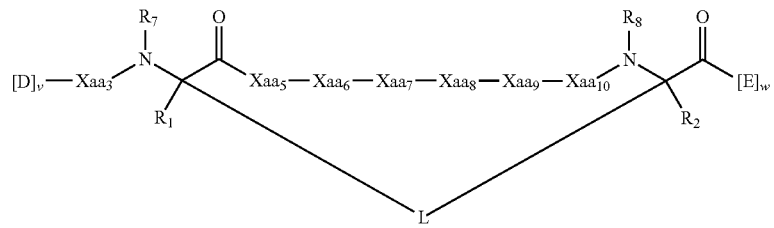

wherein:
each of $Xaa_3$, $Xaa_5$, $Xaa_6$, $Xaa_7$, $Xaa_8$, $Xaa_9$, and $Xaa_{10}$ is individually an amino acid, wherein at least three of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$His_5$-$Tyr_6$-$Trp_7$-$Ala_8$-$Gln_9$-$Leu_{10}$-$X_{11}$-$Ser_{12}$ (SEQ ID NO: 1945), wherein each X is an amino acid;

each D and E is independently a natural or non-natural amino acid or an amino acid analog;

$R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of $R_1$ and $R_2$ forms a macrocycle-forming linker L' connected to the alpha position of one of said D or E amino acids;

each L and L' is independently a macrocycle-forming linker of the formula $-L_1-L_2-$;

each $L_1$ and $L_2$ is independently alkylene, alkenylene, alkynylene, heteroalkylene, cycloalkylene, heterocycloalkylene, arylene, heteroarylene, or $[-R_4-K-R_4-]_n$, each being optionally substituted with $R_5$;

each $R_4$ is independently alkylene, alkenylene, alkynylene, heteroalkylene, cycloalkylene, heterocycloalkylene, arylene, or heteroarylene;

each K is independently O, S, SO, $SO_2$, CO, $CO_2$, or $CONR_3$;

each $R_5$ is independently halogen, alkyl, $-OR_6$, $-N(R_6)_2$, $-SR_6$, $-SOR_6$, $-SO_2R_6$, $-CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

$R_7$ is —H, alkyl, alkenyl, alkynyl, arylalkyl, cycloalkyl, heteroalkyl, cycloalkylalkyl, heterocycloalkyl, aryl, or heteroaryl, optionally substituted with $R_5$, or part of a cyclic structure with a D residue;

$R_8$ is —H, alkyl, alkenyl, alkynyl, arylalkyl, cycloalkyl, heteroalkyl, cycloalkylalkyl, heterocycloalkyl, aryl, or heteroaryl, optionally substituted with $R_5$, or part of a cyclic structure with an E residue;

v is an integer from 1-1000, for example 1-500, 1-200, 1-100, 1-50, 1-30, 1-20 or 1-10;

w is an integer from 3-1000, for example 3-500, 3-200, 3-100, 3-50, 3-30, 3-20, or 3-10; and n is an integer from 1-5.

In some embodiments, v and w are integers from 1-30. In some embodiments, w is an integer from 3-1000, for example 3-500, 3-200, 3-100, 3-50, 3-30, 3-20, or 3-10. In some embodiments, the sum of x+y+z is 3 or 6. In some embodiments, the sum of x+y+z is 3. In other embodiments, the sum of x+y+z is 6.

In some embodiments of any of the Formulas described herein, at least three of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$His_5$-$Tyr_6$-$Trp_7$-$Ala_8$-$Gln_9$-$Leu_{10}$-$X_{11}$-$Ser_{12}$ (SEQ ID NO: 1945). In other embodiments, at least four of $Xaa_3$, $Xaa_5$, $Xaa_6$, $Xaa_7$, Xaa$_8$, Xaa$_9$, and Xaa$_{10}$ are the same amino acid as the amino acid at the corresponding position of the sequence Phe$_3$-X$_4$-His$_5$-Tyr$_6$-Trp$_7$-Ala$_8$-Gln$_9$-Leu$_{10}$-X$_{11}$-Ser$_{12}$ (SEQ ID NO: 1945). In other embodiments, at least five of Xaa$_3$, Xaa$_5$, Xaa$_6$, Xaa$_7$, Xaa$_8$, Xaa$_9$, and Xaa$_{10}$ are the same amino acid as the amino acid at the corresponding position of the sequence Phe$_3$-X$_4$-His$_5$-Tyr$_6$-Trp$_7$-Ala$_8$-Gln$_9$-Leu$_{10}$-X$_{11}$-Ser$_{12}$ (SEQ ID NO: 1945). In other embodiments, at least six of Xaa$_3$, Xaa$_5$, Xaa$_6$, Xaa$_7$, Xaa$_8$, Xaa$_9$, and Xaa$_{10}$ are the same amino acid as the amino acid at the corresponding position of the sequence Phe$_3$-X$_4$-His$_5$-Tyr$_6$-Trp$_7$-Ala$_8$-Gln$_9$-Leu$_{10}$-X$_{11}$-Ser$_{12}$ (SEQ ID NO: 1945). In other embodiments, at least seven of Xaa$_3$, Xaa$_5$, Xaa$_6$, Xaa$_7$, Xaa$_8$, Xaa$_9$, and Xaa$_{10}$ are the same amino acid as the amino acid at the corresponding position of the sequence Phe$_3$-X$_4$-His$_5$-Tyr$_6$-Trp$_7$-Ala$_8$-Gln$_9$-Leu$_{10}$-X$_1$l-Ser$_{12}$ (SEQ ID NO: 1945).

In some embodiments, a peptidomimetic macrocycle has the Formula:

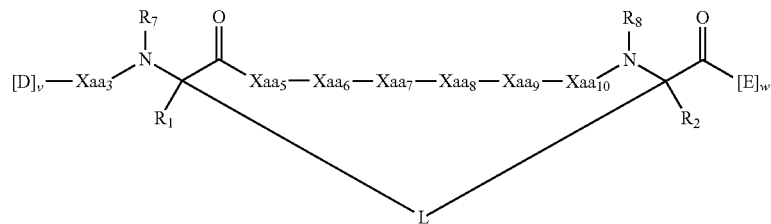

wherein:
- each of Xaa$_3$, Xaa$_5$, Xaa$_6$, Xaa$_7$, Xaa$_8$, Xaa$_9$, and Xaa$_{10}$ is individually an amino acid, wherein at least three of Xaa$_3$, Xaa$_5$, Xaa$_6$, Xaa$_7$, Xaa$_8$, Xaa$_9$, and Xaa$_{10}$ are the same amino acid as the amino acid at the corresponding position of the sequence Phe$_3$-X$_4$-Glu$_5$-Tyr$_6$-Trp$_7$-Ala$_8$-Gln$_9$-Leu$_{10}$/Cba$_{10}$-X$_{11}$-Ala$_{12}$ (SEQ ID NO: 1946), wherein each X is an amino acid;
- each D is independently a natural or non-natural amino acid or an amino acid analog;
- each E is independently a natural or non-natural amino acid or an amino acid analog, for example an amino acid selected from Ala (alanine), D-Ala (D-alanine), Aib (α-aminoisobutyric acid), Sar (N-methyl glycine), and Ser (serine);
- R$_1$ and R$_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of R$_1$ and R$_2$ forms a macrocycle-forming linker L' connected to the alpha position of one of said D or E amino acids;
- each L and L' is independently a macrocycle-forming linker of the formula -L$_1$-L$_2$-;
- each L$_1$ and L$_2$ is independently alkylene, alkenylene, alkynylene, heteroalkylene, cycloalkylene, heterocycloalkylene, arylene, heteroarylene, or [—R$_4$—K—R$_4$-]$_n$, each being optionally substituted with R$_5$;
- each R$_4$ is independently alkylene, alkenylene, alkynylene, heteroalkylene, cycloalkylene, heterocycloalkylene, arylene, or heteroarylene;
- each K is independently O, S, SO, SO$_2$, CO, CO$_2$, or CONR$_3$;
- each R$_5$ is independently halogen, alkyl, —OR$_6$, —N(R$_6$)$_2$, —SR$_6$, —SOR$_6$, —SO$_2$R$_6$, —CO$_2$R$_6$, a fluorescent moiety, a radioisotope or a therapeutic agent;
- each R$_6$ is independently —H, alkyl, alkenyl, alkynyl, arylalkyl, cycloalkylalkyl, heterocycloalkyl, a fluorescent moiety, a radioisotope or a therapeutic agent;
- R$_7$ is —H, alkyl, alkenyl, alkynyl, arylalkyl, cycloalkyl, heteroalkyl, cycloalkylalkyl, heterocycloalkyl, aryl, or heteroaryl, optionally substituted with R$_5$, or part of a cyclic structure with a D residue;
- R$_8$ is —H, alkyl, alkenyl, alkynyl, arylalkyl, cycloalkyl, heteroalkyl, cycloalkylalkyl, heterocycloalkyl, aryl, or heteroaryl, optionally substituted with R$_5$, or part of a cyclic structure with an E residue;
- v is an integer from 1-1000, for example 1-500, 1-200, 1-100, 1-50, 1-30, 1-20, or 1-10;
- w is an integer from 3-1000, for example 3-500, 3-200, 3-100, 3-50, 3-30, 3-20, or 3-10; and
- n is an integer from 1-5.

In some embodiments of the above Formula, at least three of Xaa$_3$, Xaa$_5$, Xaa$_6$, Xaa$_7$, Xaa$_8$, Xaa$_9$, and Xaa$_{10}$ are the same amino acid as the amino acid at the corresponding position of the sequence Phe$_3$-X$_4$-Glu$_5$-Tyr$_6$-Trp$_7$-Ala$_8$-Gln$_9$-Leu$_{10}$/Cba$_{10}$-X$_{11}$-Ala$_{12}$ (SEQ ID NO: 1946). In other embodiments of the above Formula, at least four of Xaa$_3$, Xaa$_5$, Xaa$_6$, Xaa$_7$, Xaa$_8$, Xaa$_9$, and Xaa$_{10}$ are the same amino acid as the amino acid at the corresponding position of the sequence Phe$_3$-X$_4$-Glu$_5$-Tyr$_6$-Trp$_7$-Ala$_8$-Gln$_9$-Leu$_{10}$/Cba$_{10}$-X$_1$-Ala$_{12}$ (SEQ ID NO: 1946). In other embodiments of the above Formula, at least five of Xaa$_3$, Xaa$_5$, Xaa$_5$, Xaa$_7$, Xaa$_8$, Xaa$_9$, and Xaa$_{10}$ are the same amino acid as the amino acid at the corresponding position of the sequence Phe$_3$-X$_4$-Glu$_5$-Tyr$_6$-Trp$_7$-Ala$_8$-Gln$_9$-Leu$_{10}$/Cba$_{10}$-X$_{11}$-Ala$_{12}$ (SEQ ID NO: 1946). In other embodiments of the above Formula, at least six of Xaa$_3$, Xaa$_5$, Xaa$_6$, Xaa$_7$, Xaa$_8$, Xaa$_9$, and Xaa$_{10}$ are the same amino acid as the amino acid at the corresponding position of the sequence Phe$_3$-X$_4$-Glu$_5$-Tyr$_6$-Trp$_7$-Ala$_8$-Gln$_9$-Leu$_{10}$/Cba$_{10}$-X$_{11}$-Ala$_{12}$ (SEQ ID NO: 1946). In other embodiments of the above Formula, at least seven of Xaa$_3$, Xaa$_5$, Xaa$_6$, Xaa$_7$, Xaa$_8$, Xaa$_9$, and Xaa$_{10}$ are the same amino acid as the amino acid at the corresponding position of the sequence Phe$_3$-X$_4$-Glu$_5$-Tyr$_6$-Trp$_7$-Ala$_8$-Gln$_9$-Leu$_{10}$/Cba$_{10}$-X$_{11}$-Ala$_{12}$ (SEQ ID NO: 1946).

In some embodiments, w is an integer from 3-10, for example 3-6, 3-8, 6-8, or 6-10. In some embodiments, w is 3. In other embodiments, w is 6. In some embodiments, v is an integer from 1-10. In some embodiments, v is 2.

In an embodiment of any of the Formulas described herein, L$_1$ and L$_2$, either alone or in combination, do not form a triazole or a thioether.

In one example, at least one of R$_1$ and R$_2$ is alkyl, unsubstituted or substituted with halo-. In another example, both R$_1$ and R$_2$ are independently alkyl, unsubstituted or substituted with halo-. In some embodiments, at least one of R$_1$ and R$_2$ is methyl. In other embodiments, R$_1$ and R$_2$ are methyl.

In some embodiments, x+y+z is at least 3. In other embodiments, x+y+z is 1, 2, 3, 4, 5, 6, 7, 8, 9 or 10. In some embodiments, the sum of x+y+z is 3 or 6. In some embodiments, the sum of x+y+z is 3. In other embodiments, the sum of x+y+z is 6. Each occurrence of A, B, C, D or E in a macrocycle or macrocycle precursor is independently selected. For example, a sequence represented by the formula $[A]_x$, when x is 3, encompasses embodiments wherein the amino acids are not identical, e.g. Gln-Asp-Ala as well as embodiments wherein the amino acids are identical, e.g. Gln-Gln-Gln. This applies for any value of x, y, or z in the indicated ranges. Similarly, when u is greater than 1, each compound can encompass peptidomimetic macrocycles which are the same or different. For example, a compound can comprise peptidomimetic macrocycles comprising different linker lengths or chemical compositions.

In some embodiments, the peptidomimetic macrocycle comprises a secondary structure which is an α-helix and $R_8$ is —H, allowing intra-helical hydrogen bonding. In some embodiments, at least one of A, B, C, D or E is an α,α-disubstituted amino acid. In one example, B is an α,α-disubstituted amino acid. For instance, at least one of A, B, C, D or E is 2-aminoisobutyric acid. In other embodiments, at least one of A, B, C, D or E is

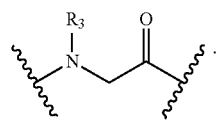

In other embodiments, the length of the macrocycle-forming linker L as measured from a first Cα to a second Cα is selected to stabilize a desired secondary peptide structure, such as an α-helix formed by residues of the peptidomimetic macrocycle including, but not necessarily limited to, those between the first Cα to a second Cα.

In some embodiments, a peptidomimetic macrocycle of Formula (I) has Formula (Ia):

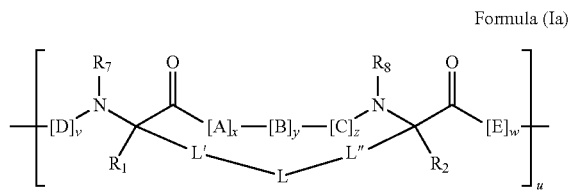

Formula (Ia)

wherein:
each A, C, D, and E is independently a natural or non-natural amino acid or an amino acid analog;
each B is independently a natural or non-natural amino acid, amino acid analog,

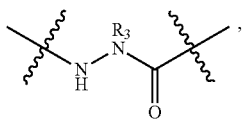

$[-NH-L_3-CO-]$, $[-NH-L_3-SO_2-]$, or $[-NH-L_3-]$;
each L is independently a macrocycle-forming linker;
each L' is independently alkylene, alkenylene, alkynylene, heteroalkylene, cycloalkylene, heterocycloalkylene, arylene, or heteroarylene, each being optionally substituted with $R_5$, or a bond, or together with $R_1$ and the atom to which both $R_1$ and L' are bound forms a ring;

each L" is independently alkylene, alkenylene, alkynylene, heteroalkylene, cycloalkylene, heterocycloalkylene, arylene, or heteroarylene, each being optionally substituted with $R_5$, or a bond, or together with $R_2$ and the atom to which both $R_2$ and L" are bound forms a ring;
each $R_1$ is independently —H, alkyl, alkenyl, alkynyl, arylalkyl, cycloalkyl, cycloalkylalkyl, heteroalkyl, or heterocycloalkyl, unsubstituted or substituted with halo-, or together with L' and the atom to which both $R_1$ and L' are bound forms a ring;
each $R_2$ is independently —H, alkyl, alkenyl, alkynyl, arylalkyl, cycloalkyl, cycloalkylalkyl, heteroalkyl, or heterocycloalkyl, unsubstituted or substituted with halo-, or together with L" and the atom to which both $R_2$ and L" are bound forms a ring;
each $R_3$ is independently hydrogen, alkyl, alkenyl, alkynyl, arylalkyl, heteroalkyl, cycloalkyl, heterocycloalkyl, cycloalkylalkyl, aryl, or heteroaryl, optionally substituted with $R_5$;
each $L_3$ is independently alkylene, alkenylene, alkynylene, heteroalkylene, cycloalkylene, heterocycloalkylene, arylene, heteroarylene, or $[-R_4-K-R_4-]_n$, each being optionally substituted with $R_5$;
each $R_4$ is independently alkylene, alkenylene, alkynylene, heteroalkylene, cycloalkylene, heterocycloalkylene, arylene, or heteroarylene;
each K is independently O, S, SO, $SO_2$, CO, $CO_2$, or $CONR_3$;
n is an integer from 1-5;
each $R_5$ is independently halogen, alkyl, $-OR_6$, $-N(R_6)_2$, $-SR_6$, $-SOR_6$, $-SO_2R_6$, $-CO_2R_6$, a fluorescent moiety, a radioisotope or a therapeutic agent;
each $R_6$ is independently —H, alkyl, alkenyl, alkynyl, arylalkyl, cycloalkylalkyl, heterocycloalkyl, a fluorescent moiety, a radioisotope or a therapeutic agent;
each $R_7$ is independently —H, alkyl, alkenyl, alkynyl, arylalkyl, cycloalkyl, heteroalkyl, cycloalkylalkyl, heterocycloalkyl, aryl, or heteroaryl, optionally substituted with $R_5$, or part of a cyclic structure with a D residue;
each $R_8$ is independently —H, alkyl, alkenyl, alkynyl, arylalkyl, cycloalkyl, heteroalkyl, cycloalkylalkyl, heterocycloalkyl, aryl, or heteroaryl, optionally substituted with $R_5$, or part of a cyclic structure with an E residue;
each v and w is independently an integer from 1-1000, for example 1-500, 1-200, 1-100, 1-50, 1-40, 1-25, 1-20, 1-15, or 1-10;
each x, y and z is independently an integer from 0-10, for example x+y+z is 2, 3, or 6; and
u is an integer from 1-10, for example 1-5, 1-3, or 1-2.

In some embodiments, L is a macrocycle-forming linker of the formula $-L_1-L_2-$. In some embodiments, each $L_1$ and $L_2$ is independently alkylene, alkenylene, alkynylene, heteroalkylene, cycloalkylene, heterocycloalkylene, arylene, heteroarylene, or $[-R_4-K-R_4-]_n$, each being optionally substituted with $R_5$; each $R_4$ is independently alkylene, alkenylene, alkynylene, heteroalkylene, cycloalkylene, heterocycloalkylene, arylene, or heteroarylene; each K is independently O, S, SO, $SO_2$, CO, $CO_2$, or $CONR_3$; and n is an integer from 1-5.

In one example, at least one of $R_1$ and $R_2$ is alkyl, unsubstituted or substituted with halo-. In another example, both $R_1$ and $R_2$ are independently alkyl, unsubstituted or substituted with halo-. In some embodiments, at least one of $R_1$ and $R_2$ is methyl. In other embodiments, $R_1$ and $R_2$ are methyl.

In some embodiments, x+y+z is at least 2. In other embodiments, x+y+z is 1, 2, 3, 4, 5, 6, 7, 8, 9 or 10. Each occurrence of A, B, C, D or E in a macrocycle or macrocycle precursor is independently selected. For example, a sequence represented by the formula $[A]_x$, when x is 3, encompasses embodiments where the amino acids are not identical, e.g. Gln-Asp-Ala as well as embodiments wherein the amino acids are identical, e.g. Gln-Gln-Gln. This applies for any value of x, y, or z in the indicated ranges. Similarly, when u is greater than 1, each compound can encompass peptidomimetic macrocycles which are the same or different. For example, a compound can comprise peptidomimetic macrocycles comprising different linker lengths or chemical compositions.

In some embodiments, the peptidomimetic macrocycle comprises a secondary structure which is a helix and $R_8$ is —H, allowing intra-helical hydrogen bonding. In some embodiments, at least one of A, B, C, D or E is an α,α-disubstituted amino acid. In one example, B is an α,α-disubstituted amino acid. For instance, at least one of A, B, C, D or E is 2-aminoisobutyric acid. In other embodiments, at least one of A, B, C, D or E is

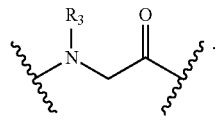

In other embodiments, the length of the macrocycle-forming linker L as measured from a first Cα to a second Cα is selected to stabilize a desired secondary peptide structure, such as a helix formed by residues of the peptidomimetic macrocycle including, but not necessarily limited to, those between the first Cα to a second Cα.

In one embodiment, the peptidomimetic macrocycle of Formula (I) is:

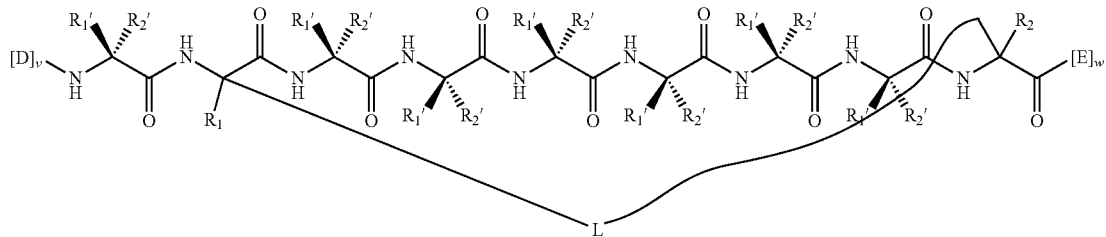

wherein each $R_1$ and $R_2$ is independently —H, alkyl, alkenyl, alkynyl, arylalkyl, cycloalkyl, cycloalkylalkyl, heteroalkyl, or heterocycloalkyl, unsubstituted or substituted with halo-.

In related embodiments, the peptidomimetic macrocycle of Formula (I) is:

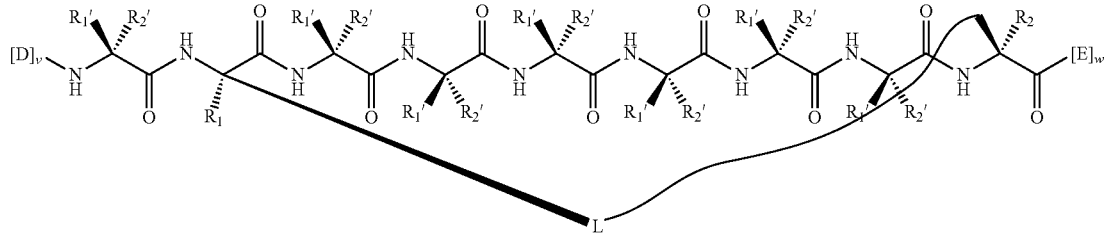

wherein each $R_1'$ and $R_2'$ is independently an amino acid.

In other embodiments, the peptidomimetic macrocycle of Formula (I) is a compound of any of the formulas shown below:

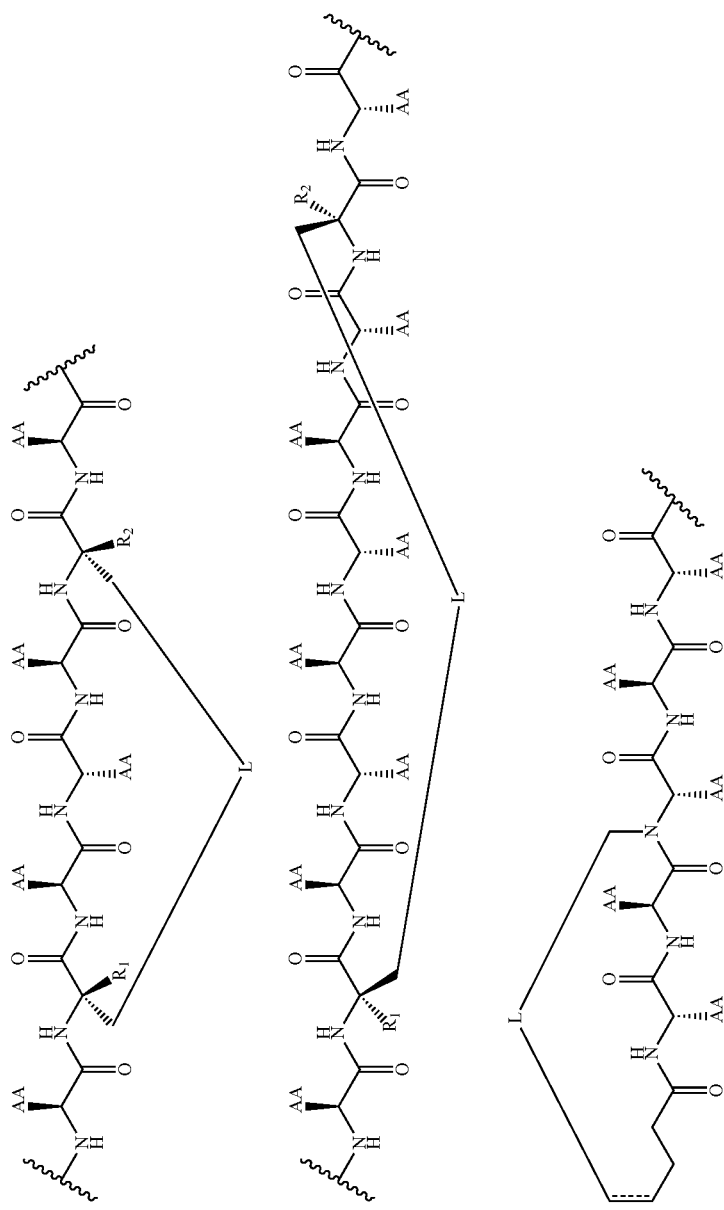

-continued
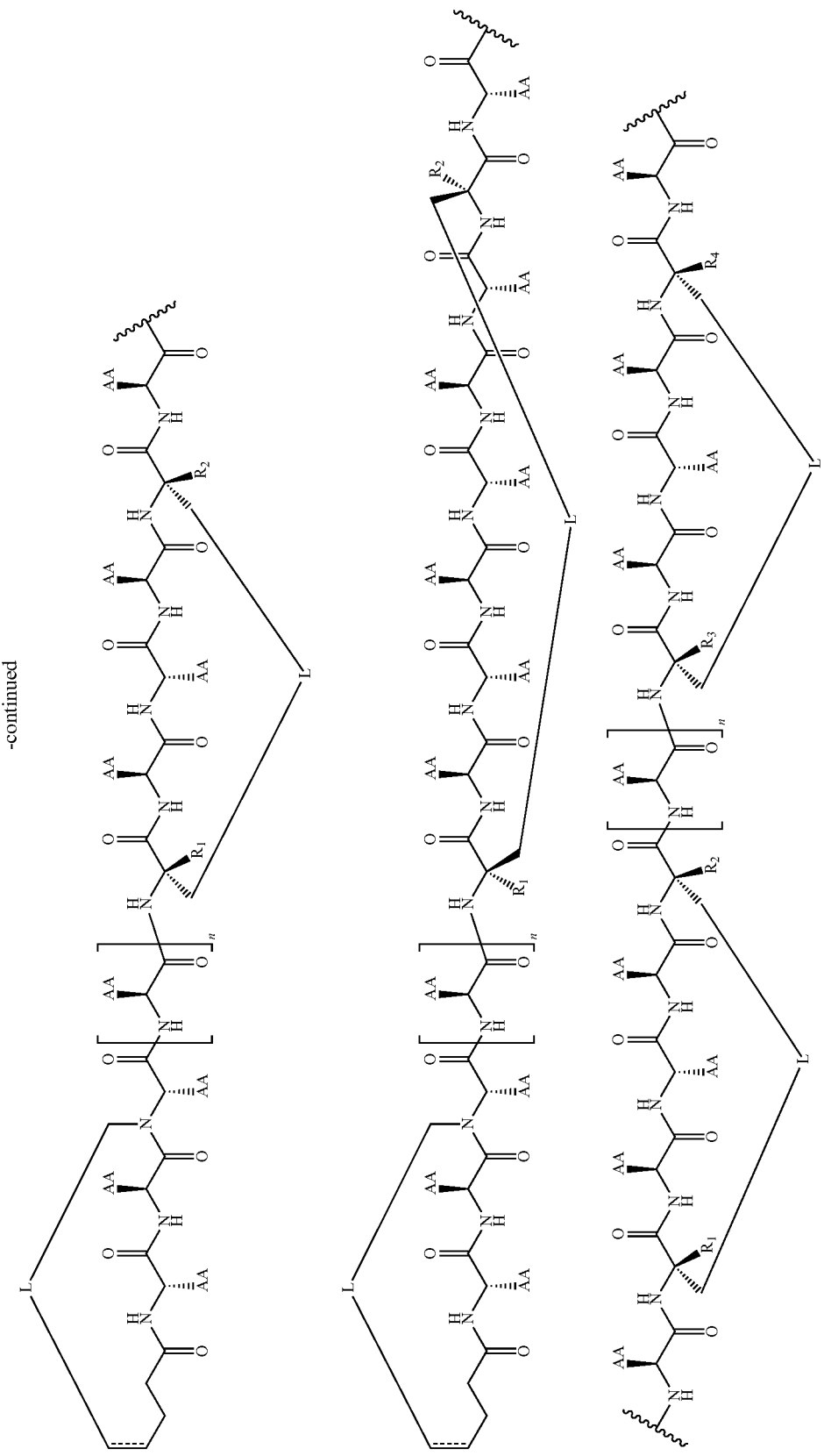

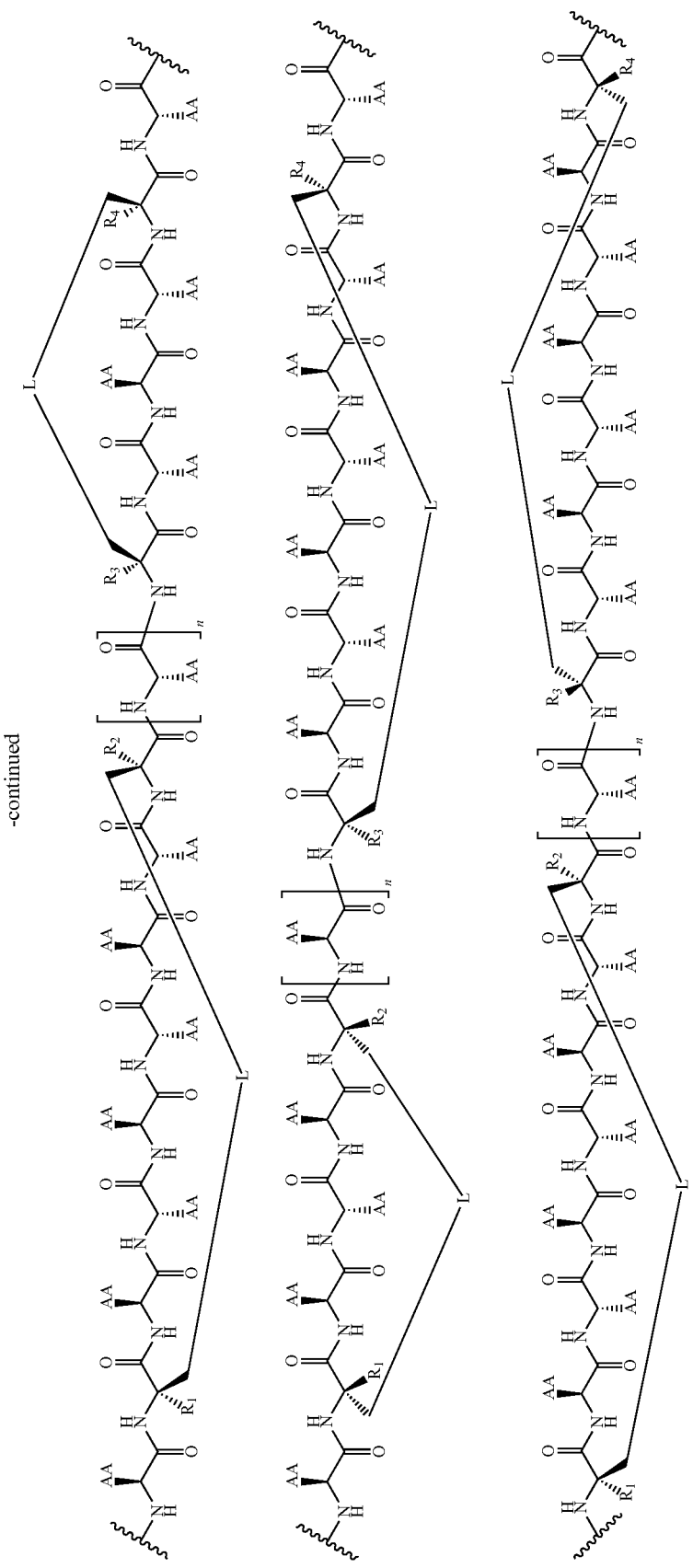

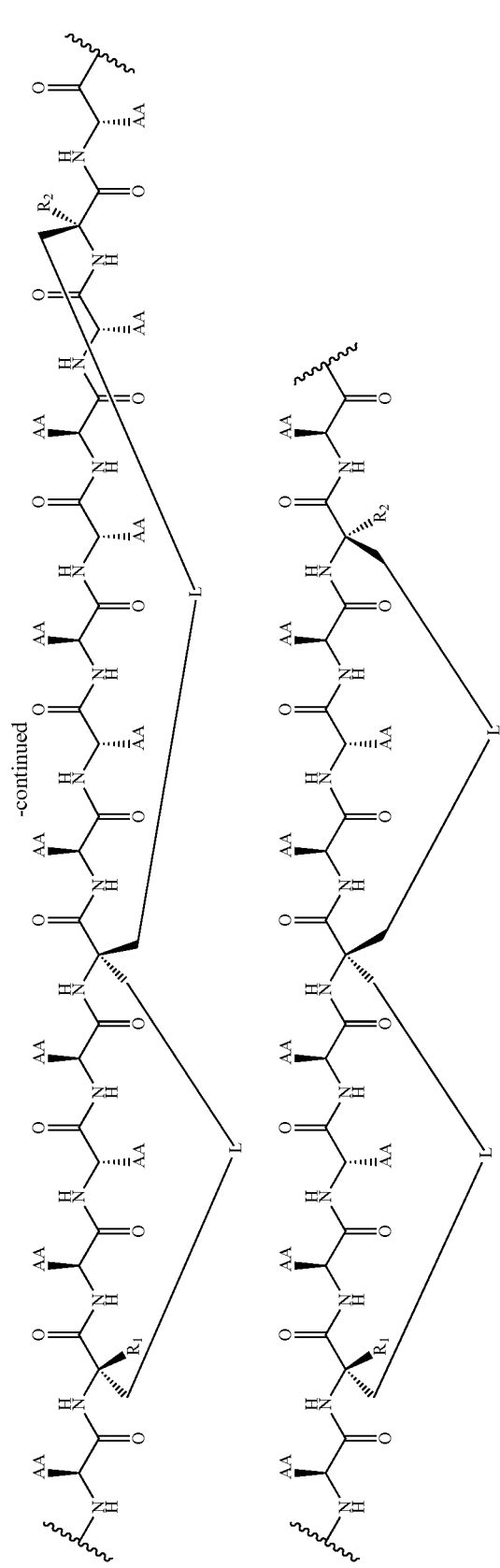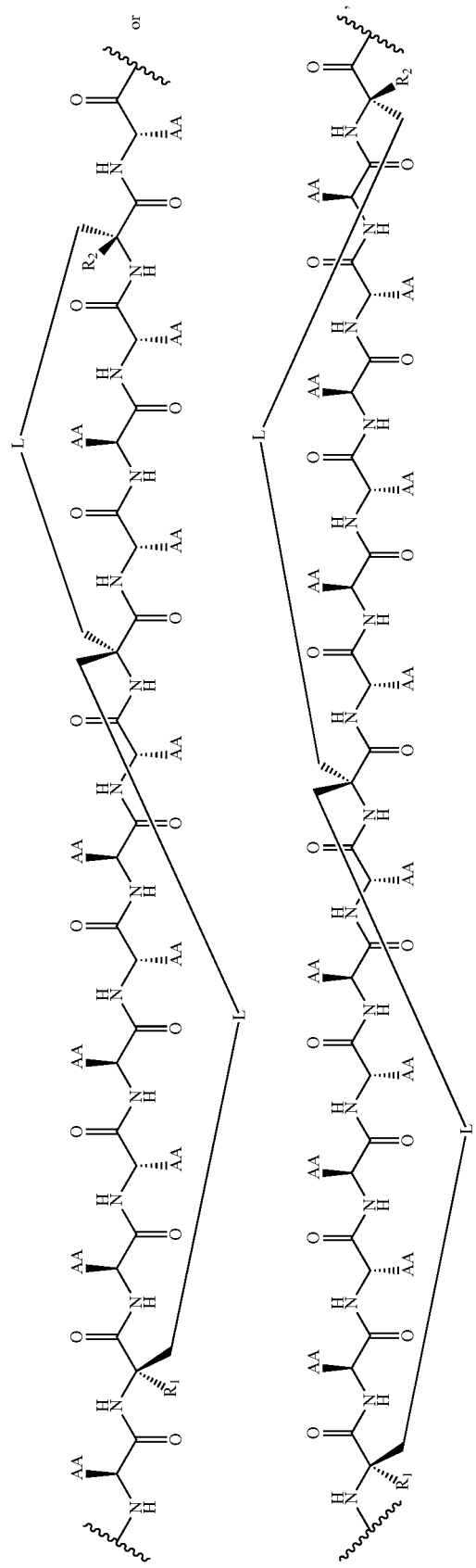

wherein "AA" represents any natural or non-natural amino acid side chain and '⌇' is $[D]_v$, $[E]_w$ as defined above, and n is an integer between 0 and 20, 50, 100, 200, 300, 400 or 500. In some embodiments, n is 0. In other embodiments, n is less than 50.

Exemplary embodiments of the macrocycle-forming linker L are shown below.

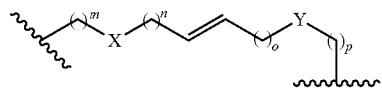

where X, Y = —CH$_2$—, O, S, or NH
m, n, o, p = 0 -10

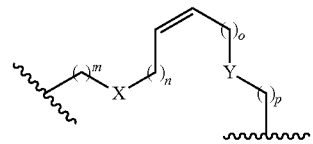

where X, Y = —CH$_2$—, O, S, or NH
m, n, o, p = 0 -10

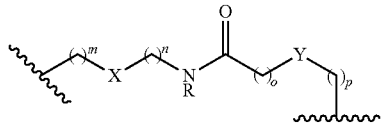

where X, Y = —CH$_2$—, O, S, or NH
m, n, o, p = 0 -10
R = H, alkyl, other substituent

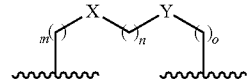

where X, Y = —CH$_2$—, O, S, or NH
m, n, o = 0 -10

In other embodiments, D and/or E in the compound of Formula I are further modified to facilitate cellular uptake. In some embodiments, lipidating or PEGylating a peptidomimetic macrocycle facilitates cellular uptake, increases bioavailability, increases blood circulation, alters pharmacokinetics, decreases immunogenicity and/or decreases the needed frequency of administration.

In other embodiments, at least one of [D] and [E] in the compound of Formula I represents a moiety comprising an additional macrocycle-forming linker such that the peptidomimetic macrocycle comprises at least two macrocycle-forming linkers. In a specific embodiment, a peptidomimetic macrocycle comprises two macrocycle-forming linkers. In an embodiment, u is 2.

In some embodiments, the peptidomimetic macrocycles have the Formula (I):

Formula (I)

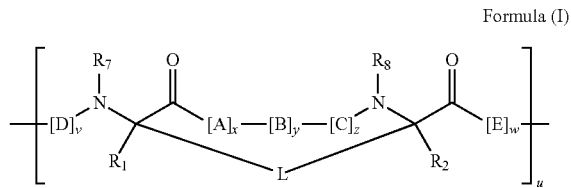

wherein:
each A, C, D, and E is independently a natural or non-natural amino acid or an amino acid analog;
each B is independently a natural or non-natural amino acid, amino acid analog,

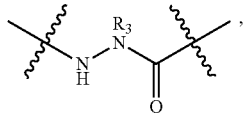

[—NH-L$_3$-CO—], [—NH-L$_3$-SO$_2$—], or [—NH-L$_3$-];
each R$_1$ and R$_2$ is independently —H, alkyl, alkenyl, alkynyl, arylalkyl, cycloalkyl, cycloalkylalkyl, heteroalkyl, or heterocycloalkyl, unsubstituted or substituted with halo-, or at least one of R$_1$ and R$_2$ forms a macrocycle-forming linker L' connected to the alpha position of one of said D or E amino acids;
each R$_3$ is independently hydrogen, alkyl, alkenyl, alkynyl, arylalkyl, heteroalkyl, cycloalkyl, heterocycloalkyl, cycloalkylalkyl, aryl, or heteroaryl, optionally substituted with R$_5$;
each L and L' is independently macrocycle-forming linker of the formula

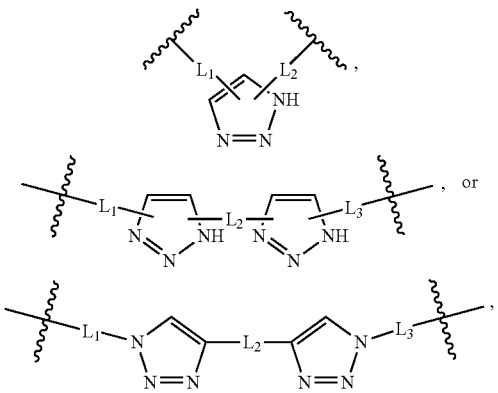

wherein each L$_1$, L$_2$ and L$_3$ is independently alkylene, alkenylene, alkynylene, heteroalkylene, cycloalkylene, heterocycloalkylene, arylene, heteroarylene, or [—R$_4$—K—R$_4$-]$_n$, each being optionally substituted with R$_5$;
each R$_4$ is independently alkylene, alkenylene, alkynylene, heteroalkylene, cycloalkylene, heterocycloalkylene, arylene, or heteroarylene;
each K is independently O, S, SO, SO$_2$, CO, CO$_2$, or CONR$_3$;
each R$_5$ is independently halogen, alkyl, —OR$_6$, —N(R$_6$)$_2$, —SR$_6$, —SOR$_6$, —SO$_2$R$_6$, —CO$_2$R$_6$, a fluorescent moiety, a radioisotope or a therapeutic agent;
each R$_6$ is independently —H, alkyl, alkenyl, alkynyl, arylalkyl, cycloalkylalkyl, heterocycloalkyl, a fluorescent moiety, a radioisotope or a therapeutic agent;
each R$_7$ is independently —H, alkyl, alkenyl, alkynyl, arylalkyl, cycloalkyl, heteroalkyl, cycloalkylalkyl, heterocycloalkyl, aryl, or heteroaryl, optionally substituted with R$_5$, or part of a cyclic structure with a D residue;
each R$_8$ is independently —H, alkyl, alkenyl, alkynyl, arylalkyl, cycloalkyl, heteroalkyl, cycloalkylalkyl, heterocycloalkyl, aryl, or heteroaryl, optionally substituted with R$_5$, or part of a cyclic structure with an E residue;

each v and w is independently an integer from 1-1000;
each x, y and z is independently an integer from 0-10;
us is an integer from 1-10; and
n is an integer from 1-5.

In one example, at least one of $R_1$ and $R_2$ is alkyl that is unsubstituted or substituted with halo-. In another example, both $R_1$ and $R_2$ are independently alkyl that are unsubstituted or substituted with halo-. In some embodiments, at least one of $R_1$ and $R_2$ is methyl. In other embodiments, $R_1$ and $R_2$ are methyl.

In some embodiments, x+y+z is at least 2. In other embodiments, x+y+z is 1, 2, 3, 4, 5, 6, 7, 8, 9 or 10. Each occurrence of A, B, C, D or E in a macrocycle or macrocycle precursor is independently selected. For example, a sequence represented by the formula $[A]_x$, when x is 3, encompasses embodiments where the amino acids are not identical, e.g. Gln-Asp-Ala as well as embodiments wherein the amino acids are identical, e.g. Gln-Gln-Gln. This applies for any value of x, y, or z in the indicated ranges.

In some embodiments, each of the first two amino acid represented by E comprises an uncharged side chain or a negatively charged side chain. In some embodiments, each of the first three amino acid represented by E comprises an uncharged side chain or a negatively charged side chain. In some embodiments, each of the first four amino acid represented by E comprises an uncharged side chain or a negatively charged side chain. In some embodiments, one or more or each of the amino acid that is i+1, i+2, i+3, i+4, i+5, and/or i+6 with respect to $Xaa_{13}$ represented by E comprises an uncharged side chain or a negatively charged side chain.

In some embodiments, the first C-terminal amino acid and/or the second C-terminal amino acid represented by E comprise a hydrophobic side chain. For example, the first C-terminal amino acid and/or the second C-terminal amino acid represented by E comprises a hydrophobic side chain, for example a small hydrophobic side chain. In some embodiments, the first C-terminal amino acid, the second C-terminal amino acid, and/or the third C-terminal amino acid represented by E comprise a hydrophobic side chain. For example, the first C-terminal amino acid, the second C-terminal amino acid, and/or the third C-terminal amino acid represented by E comprises a hydrophobic side chain, for example a small hydrophobic side chain. In some embodiments, one or more or each of the amino acid that is i+1, i+2, i+3, i+4, i+5, and/or i+6 with respect to $Xaa_{13}$ represented by E comprises an uncharged side chain or a negatively charged side chain.

In some embodiments, w is between 1 and 1000. For example, the first amino acid represented by E comprises a small hydrophobic side chain. In some embodiments, w is between 2 and 1000. For example, the second amino acid represented by E comprises a small hydrophobic side chain. In some embodiments, w is between 3 and 1000. For example, the third amino acid represented by E comprises a small hydrophobic side chain. For example, the third amino acid represented by E comprises a small hydrophobic side chain. In some embodiments, w is between 4 and 1000. In some embodiments, w is between 5 and 1000. In some embodiments, w is between 6 and 1000. In some embodiments, w is between 7 and 1000. In some embodiments, w is between 8 and 1000.

In some embodiments, the peptidomimetic macrocycle comprises a secondary structure which is a helix and $R_8$ is —H, allowing intra-helical hydrogen bonding. In some embodiments, at least one of A, B, C, D or E is an α,α-disubstituted amino acid. In one example, B is an α,α-disubstituted amino acid. For instance, at least one of A, B, C, D or E is 2-aminoisobutyric acid. In other embodiments, at least one of A, B, C, D or E is

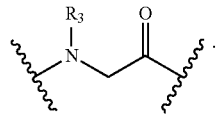

In other embodiments, the length of the macrocycle-forming linker L as measured from a first Cα to a second Cα is selected to stabilize a desired secondary peptide structure, such as a helix formed by residues of the peptidomimetic macrocycle including, but not necessarily limited to, those between the first Cα to a second Cα.

In some embodiments, L is a macrocycle-forming linker of the formula

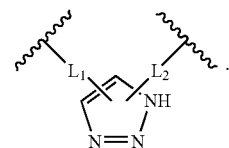

In some embodiments, L is a macrocycle-forming linker of the formula

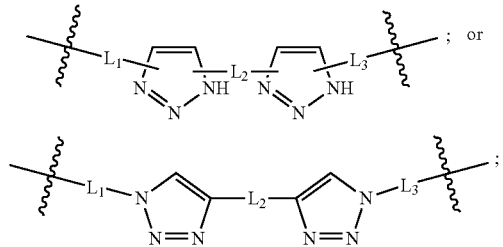

or a tautomer thereof.

Exemplary embodiments of the macro cycle-forming linker L are shown below:

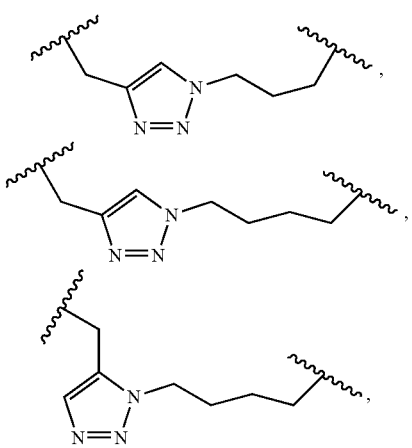

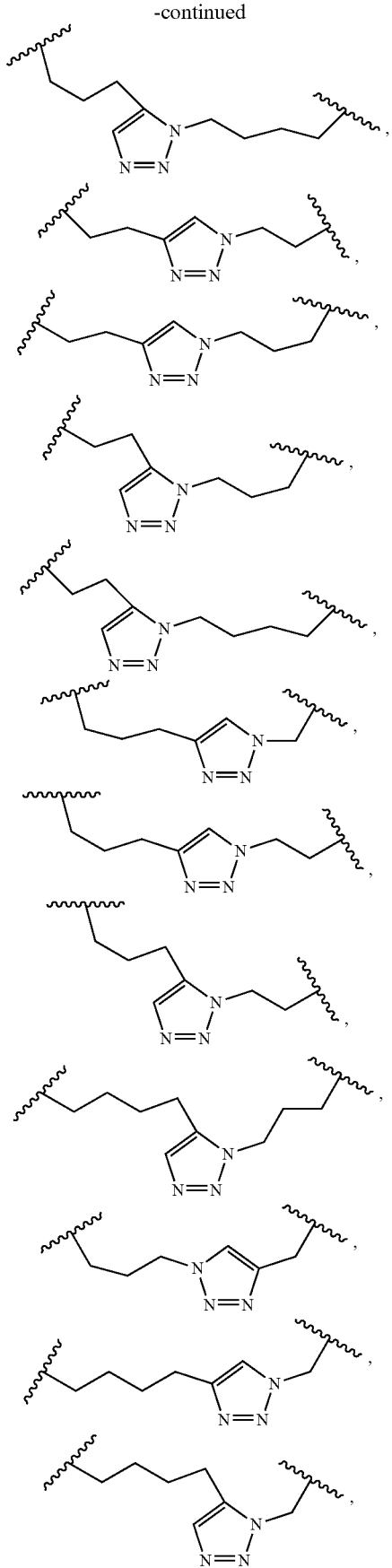
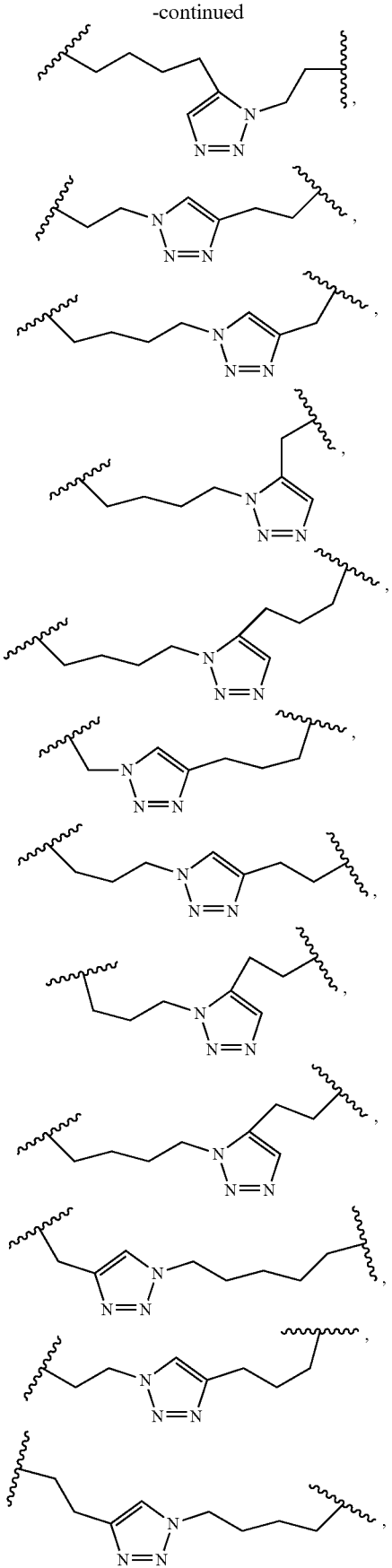

61
-continued
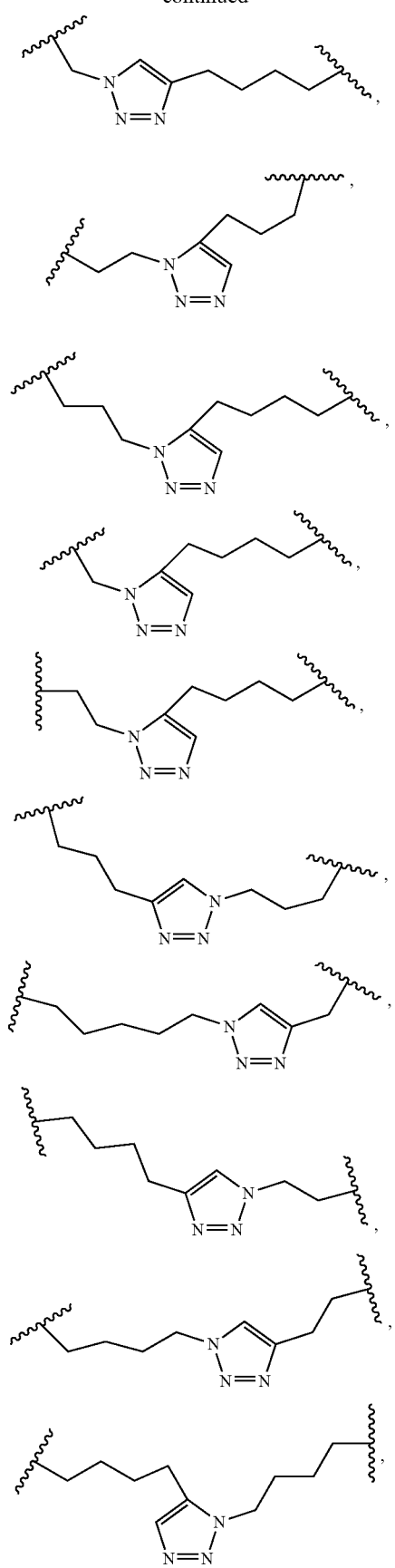
62
-continued
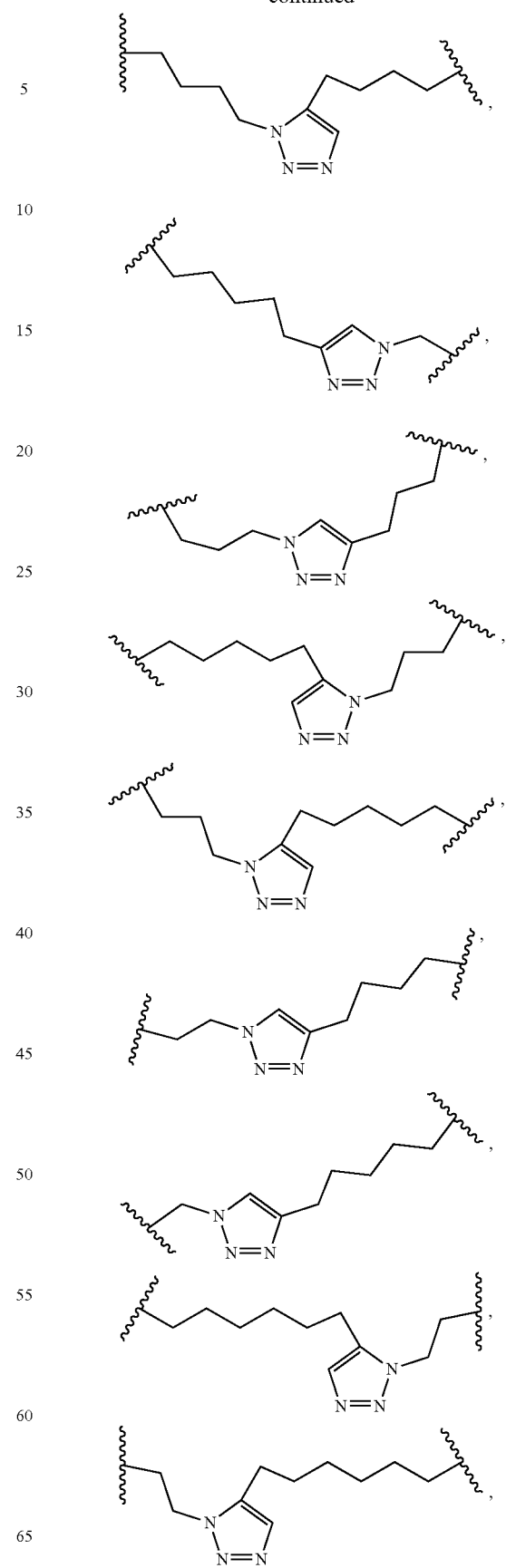

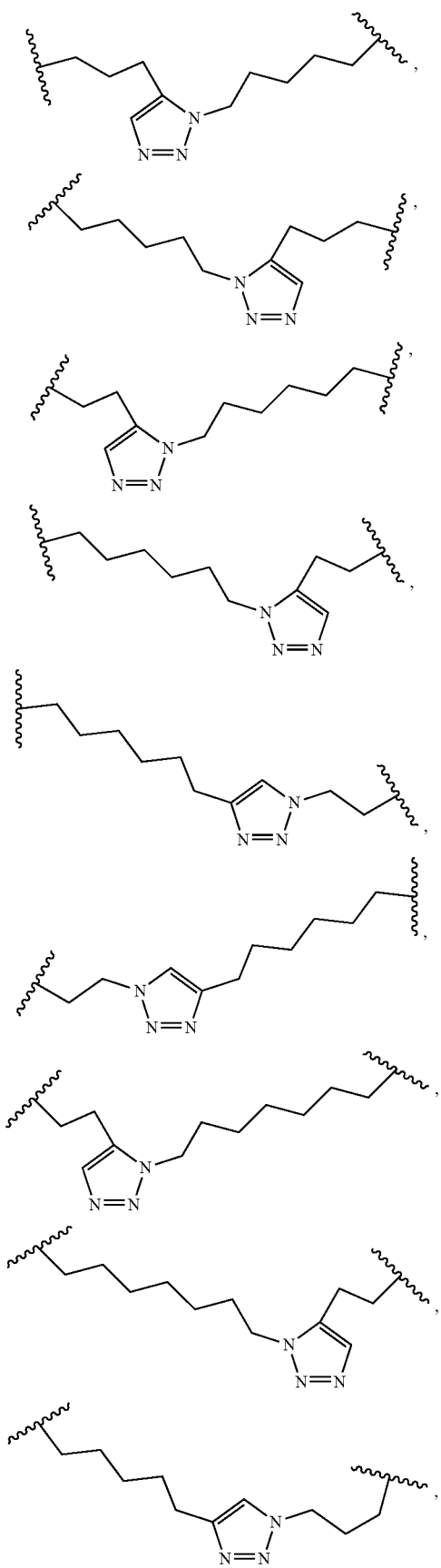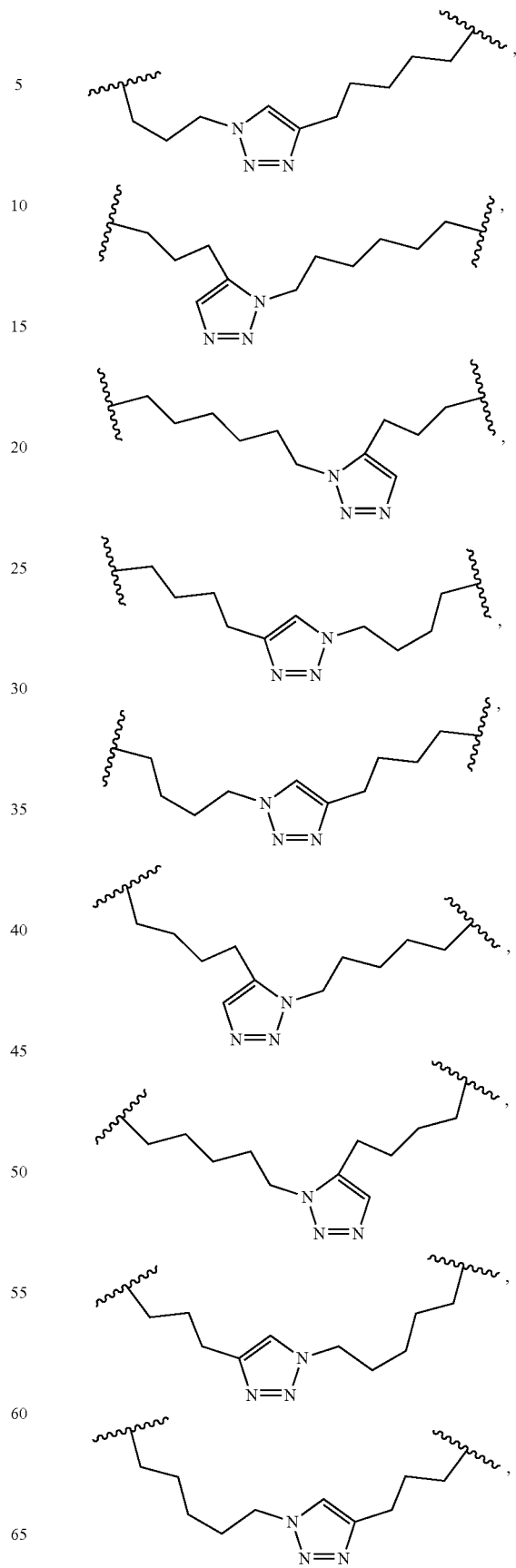

65
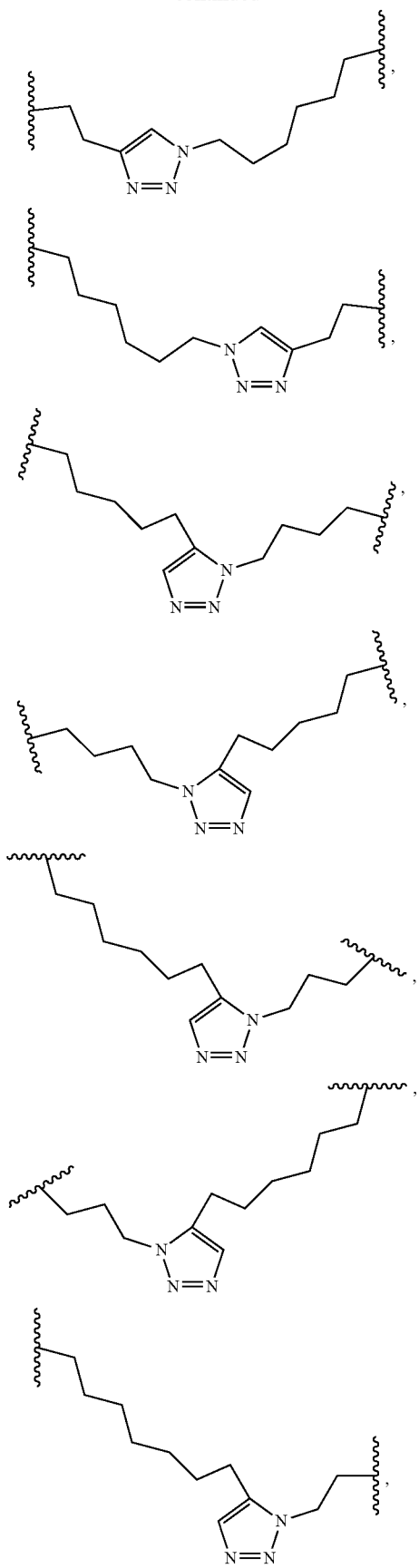
66
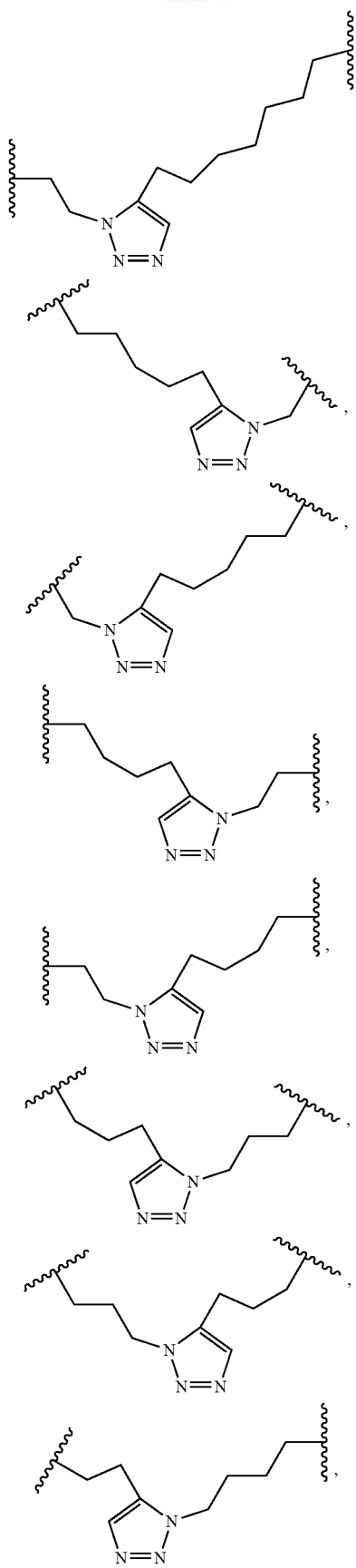

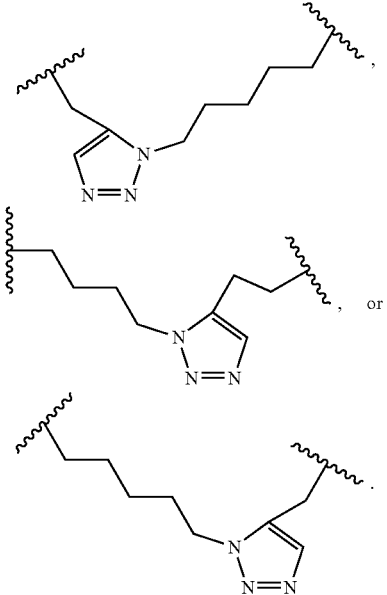

Amino acids which are used in the formation of triazole crosslinkers are represented according to the legend indicated below. Stereochemistry at the alpha position of each amino acid is S unless otherwise indicated. For azide amino acids, the number of carbon atoms indicated refers to the number of methylene units between the alpha carbon and the terminal azide. For alkyne amino acids, the number of carbon atoms indicated is the number of methylene units between the alpha position and the triazole moiety plus the two carbon atoms within the triazole group derived from the alkyne.

| | |
|---|---|
| $5a5 | Alpha-Me alkyne 1,5 triazole (5 carbon) |
| $5n3 | Alpha-Me azide 1,5 triazole (3 carbon) |
| $4rn6 | Alpha-Me R-azide 1,4 triazole (6 carbon) |
| $4a5 | Alpha-Me alkyne 1,4 triazole (5 carbon) |

In some embodiments, any of the macrocycle-forming linkers described herein can be used in any combination with any of the sequences shown in Table 1, Table 1a, Table 1b, Table 1c, Table 2a, Table 2b, Table 3, or Table 3a and also with any of the R— substituents indicated herein.

In some embodiments, the peptidomimetic macrocycle comprises at least one α-helix motif. For example, A, B and/or C in the compound of Formula I include one or more α-helices. As a general matter, α-helices include between 3 and 4 amino acid residues per turn. In some embodiments, the α-helix of the peptidomimetic macrocycle includes 1 to 5 turns and, therefore, 3 to 20 amino acid residues. In specific embodiments, the α-helix includes 1 turn, 2 turns, 3 turns, 4 turns, or 5 turns. In some embodiments, the macrocycle-forming linker stabilizes an α-helix motif included within the peptidomimetic macrocycle. Thus, in some embodiments, the length of the macrocycle-forming linker L from a first Cα to a second Cα is selected to increase the stability of an α-helix.

In some embodiments, the macrocycle-forming linker spans from 1 turn to 5 turns of the α-helix. In some embodiments, the macrocycle-forming linker spans approximately 1 turn, 2 turns, 3 turns, 4 turns, or 5 turns of the α-helix. In some embodiments, the length of the macrocycle-forming linker is approximately 5 Å to 9 Å per turn of the α-helix, or approximately 6 Å to 8 Å per turn of the α-helix.

Where the macrocycle-forming linker spans approximately 1 turn of an α-helix, the length is equal to approximately 5 carbon-carbon bonds to 13 carbon-carbon bonds, approximately 7 carbon-carbon bonds to 11 carbon-carbon bonds, or approximately 9 carbon-carbon bonds. Where the macrocycle-forming linker spans approximately 2 turns of an α-helix, the length is equal to approximately 8 carbon-carbon bonds to 16 carbon-carbon bonds, approximately 10 carbon-carbon bonds to 14 carbon-carbon bonds, or approximately 12 carbon-carbon bonds. Where the macrocycle-forming linker spans approximately 3 turns of an α-helix, the length is equal to approximately 14 carbon-carbon bonds to 22 carbon-carbon bonds, approximately 16 carbon-carbon bonds to 20 carbon-carbon bonds, or approximately 18 carbon-carbon bonds. Where the macrocycle-forming linker spans approximately 4 turns of an α-helix, the length is equal to approximately 20 carbon-carbon bonds to 28 carbon-carbon bonds, approximately 22 carbon-carbon bonds to 26 carbon-carbon bonds, or approximately 24 carbon-carbon bonds. Where the macrocycle-forming linker spans approximately 5 turns of an α-helix, the length is equal to approximately 26 carbon-carbon bonds to 34 carbon-carbon bonds, approximately 28 carbon-carbon bonds to 32 carbon-carbon bonds, or approximately 30 carbon-carbon bonds. Where the macrocycle-forming linker spans approximately 1 turn of an α-helix, the linkage contains approximately 4 atoms to 12 atoms, approximately 6 atoms to 10 atoms, or approximately 8 atoms. Where the macrocycle-forming linker spans approximately 2 turns of the α-helix, the linkage contains approximately 7 atoms to 15 atoms, approximately 9 atoms to 13 atoms, or approximately 11 atoms. Where the macrocycle-forming linker spans approximately 3 turns of the α-helix, the linkage contains approximately 13 atoms to 21 atoms, approximately 15 atoms to 19 atoms, or approximately 17 atoms. Where the macrocycle-forming linker spans approximately 4 turns of the α-helix, the linkage contains approximately 19 atoms to 27 atoms, approximately 21 atoms to 25 atoms, or approximately 23 atoms. Where the macrocycle-forming linker spans approximately 5 turns of the α-helix, the linkage contains approximately 25 atoms to 33 atoms, approximately 27 atoms to 31 atoms, or approximately 29 atoms.

Where the macrocycle-forming linker spans approximately 1 turn of the α-helix, the resulting macrocycle forms a ring containing approximately 17 members to 25 members, approximately 19 members to 23 members, or approximately 21 members. Where the macrocycle-forming linker spans approximately 2 turns of the α-helix, the resulting macrocycle forms a ring containing approximately 29 members to 37 members, approximately 31 members to 35 members, or approximately 33 members. Where the macrocycle-forming linker spans approximately 3 turns of the α-helix, the resulting macrocycle forms a ring containing approximately 44 members to 52 members, approximately 46 members to 50 members, or approximately 48 members. Where the macrocycle-forming linker spans approximately 4 turns of the α-helix, the resulting macrocycle forms a ring containing approximately 59 members to 67 members, approximately 61 members to 65 members, or approximately 63 members. Where the macrocycle-forming linker spans approximately 5 turns of the α-helix, the resulting macrocycle forms a ring containing approximately 74 members to 82 members, approximately 76 members to 80 members, or approximately 78 members.

In other embodiments, provided are peptidomimetic macrocycles of Formula (II) or (IIa):

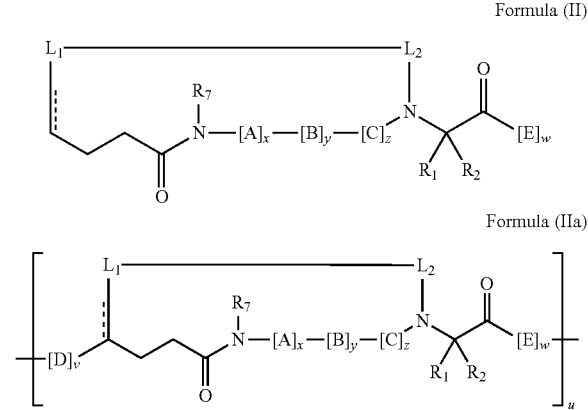

wherein:
each A, C, D, and E is independently a natural or non-natural amino acid or an amino acid analog, and the terminal D and E independently optionally include a capping group;
each B is independently a natural or non-natural amino acid, amino acid analog,

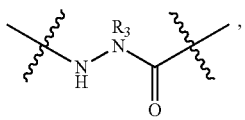

[—NH-L$_3$-CO—], [—NH-L$_3$-SO$_2$—], or [—NH-L$_3$-];
each R$_1$ and R$_2$ is independently —H, alkyl, alkenyl, alkynyl, arylalkyl, cycloalkyl, cycloalkylalkyl, heteroalkyl, or heterocycloalkyl, unsubstituted or substituted with halo-; or at least one of R$_1$ and R$_2$ forms a macrocycle-forming linker L' connected to the alpha position of one of said D or E amino acids;
each R$_3$ is independently hydrogen, alkyl, alkenyl, alkynyl, arylalkyl, heteroalkyl, cycloalkyl, heterocycloalkyl, cycloalkylalkyl, aryl, or heteroaryl, optionally substituted with R$_5$;
each L and L' is a macrocycle-forming linker of the formula -L$_1$-L$_2$-;
each L$_1$, L$_2$, and L$_3$ is independently alkylene, alkenylene, alkynylene, heteroalkylene, cycloalkylene, heterocycloalkylene, arylene, heteroarylene, or [—R$_4$—K—R$_4$-]$_n$, each being optionally substituted with R$_5$;
each R$_4$ is independently alkylene, alkenylene, alkynylene, heteroalkylene, cycloalkylene, heterocycloalkylene, arylene, or heteroarylene;
each K is independently O, S, SO, SO$_2$, CO, CO$_2$, or CONR$_3$;
each R$_5$ is independently halogen, alkyl, —OR$_6$, —N(R$_6$)$_2$, —SR$_6$, —SOR$_6$, —SO$_2$R$_6$, —CO$_2$R$_6$, a fluorescent moiety, a radioisotope or a therapeutic agent;
each R$_6$ is independently —H, alkyl, alkenyl, alkynyl, arylalkyl, cycloalkylalkyl, heterocycloalkyl, a fluorescent moiety, a radioisotope or a therapeutic agent;
each R$_7$ is independently —H, alkyl, alkenyl, alkynyl, arylalkyl, heteroalkyl, cycloalkylalkyl, heterocycloalkyl, aryl, or heteroaryl, optionally substituted with R$_5$;

each v and w is independently an integer from 1-1000;
u is an integer from 1-10;
each x, y, and z is independently integers from 0-10; and
n is an integer from 1-5.

In one example, L$_1$ and L$_2$, either alone or in combination, do not form a triazole or a thioether.

In one example, at least one of R$_1$ and R$_2$ is alkyl, unsubstituted or substituted with halo-. In another example, both R$_1$ and R$_2$ are independently alkyl, unsubstituted or substituted with halo-. In some embodiments, at least one of R$_1$ and R$_2$ is methyl. In other embodiments, R$_1$ and R$_2$ are methyl.

In some embodiments, x+y+z is at least 1. In other embodiments, x+y+z is at least 2. In other embodiments, x+y+z is 1, 2, 3, 4, 5, 6, 7, 8, 9 or 10. Each occurrence of A, B, C, D or E in a macrocycle or macrocycle precursor is independently selected. For example, a sequence represented by the formula [A]$_x$, when x is 3, encompasses embodiments wherein the amino acids are not identical, e.g. Gln-Asp-Ala as well as embodiments wherein the amino acids are identical, e.g. Gln-Gln-Gln. This applies for any value of x, y, or z in the indicated ranges.

In some embodiments, the peptidomimetic macrocycle comprises a secondary structure which is an α-helix and R$_8$ is —H, allowing intra-helical hydrogen bonding. In some embodiments, at least one of A, B, C, D or E is an α,α-disubstituted amino acid. In one example, B is an α,α-disubstituted amino acid. For example, at least one of A, B, C, D or E is 2-aminoisobutyric acid. In other embodiments, at least one of A, B, C, D or E is

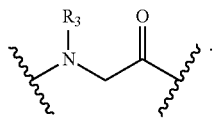

In other embodiments, the length of the macrocycle-forming linker L as measured from a first Cα to a second Cα is selected to stabilize a desired secondary peptide structure, such as an α-helix formed by residues of the peptidomimetic macrocycle including, but not necessarily limited to, those between the first Cα to a second Cα.

Exemplary embodiments of the macrocycle-forming linker -L$_1$-L$_2$- are shown below.

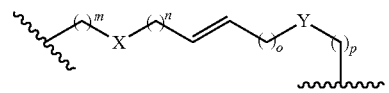

where X, Y = —CH$_2$—, O, S, or NH m, n, o, p = 0 -10

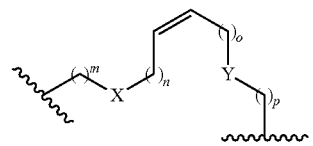

where X, Y = —CH$_2$—, O, S, or NH m, n, o, p = 0 -10

-continued

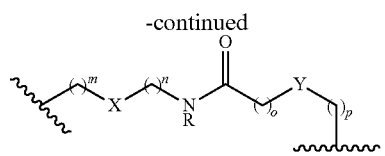

where X, Y = —CH$_2$—, O, S, or NH m, n, o, p = 0 -10

R = H, alkyl, other substituent

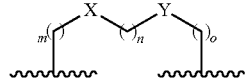

where X, Y = —CH$_2$—, O, S, or NH m, n, o = 0 -10

In some embodiments, the peptidomimetic macrocycle has the Formula (III) or Formula (IIIa):

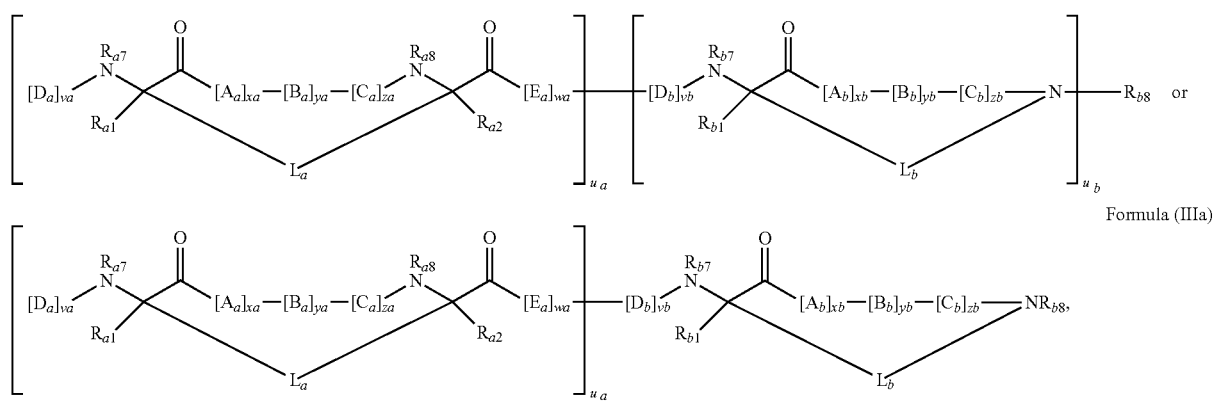

wherein:
each $A_a$, $C_a$, $D_a$, $E_a$, $A_b$, $C_b$, and $D_b$ is independently a natural or non-natural amino acid or an amino acid analog;
each $B_a$ and $B_b$ is independently a natural or non-natural amino acid, amino acid analog,

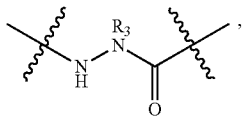

[—NH-L$_4$-CO—], [—NH-L$_4$-SO$_2$—], or [—NH-L$_4$-];
each $R_{a1}$ is independently alkyl, alkenyl, alkynyl, arylalkyl, cycloalkyl, cycloalkylalkyl, heteroalkyl, or heterocycloalkyl, any of which is unsubstituted or substituted; or H; or $R_{a1}$ forms a macrocycle-forming linker L' connected to the alpha position of one of the $D_a$ or $E_a$ amino acids; or together with $L_a$ forms a ring that is unsubstituted or substituted;
each $R_{a2}$ is independently alkyl, alkenyl, alkynyl, arylalkyl, cycloalkyl, cycloalkylalkyl, heteroalkyl, or heterocycloalkyl, any of which is unsubstituted or substituted; or H; or $R_{a2}$ forms a macrocycle-forming linker L' connected to the alpha position of one of the $D_a$ or $E_a$ amino acids; or together with $L_a$ forms a ring that is unsubstituted or substituted;
each $R_{b1}$ is independently alkyl, alkenyl, alkynyl, arylalkyl, cycloalkyl, cycloalkylalkyl, heteroalkyl, or heterocycloalkyl, any of which is unsubstituted or substituted; or H; or $R_{b1}$ forms a macrocycle-forming linker L' connected to the alpha position of one of the $D_b$ amino acids; or together with $L_b$ forms a ring that is unsubstituted or substituted;
each $R_3$ is independently alkyl, alkenyl, alkynyl, arylalkyl, heteroalkyl, cycloalkyl, heterocycloalkyl, cycloalkylalkyl, cycloaryl, or heterocycloaryl, any of which is unsubstituted or substituted, or H;
each $L_a$ is independently a macrocycle-forming linker, and optionally forms a ring with $R_{a1}$ or $R_{a2}$ that is unsubstituted or substituted;
each $L_b$ is independently a macrocycle-forming linker, and optionally forms a ring with $R_{b1}$ that is unsubstituted or substituted;
each L' is independently a macrocycle-forming linker;
each $L_4$ is independently alkylene, alkenylene, alkynylene, heteroalkylene, cycloalkylene, heterocycloalkylene, cycloarylene, heterocycloarylene, or [—R$_4$—K—R$_4$-]$_n$, any of which is unsubstituted or substituted;
each $R_4$ is independently alkylene, alkenylene, alkynylene, heteroalkylene, cycloalkylene, heterocycloalkylene, arylene, or heteroarylene, any of which is unsubstituted or substituted;
each K is independently O, S, SO, SO$_2$, CO, CO$_2$, OCO$_2$, NR$_3$, CONR$_3$, OCONR$_3$, OSO$_2$NR$_3$, NR$_{3q}$, CONR$_{3q}$, OCONR$_{3q}$, or OSO$_2$NR$_{3q}$, wherein each $R_{3q}$ is independently a point of attachment to $R_{a1}$, $R_{a2}$, or $R_{b1}$;
$R_{a7}$ is alkyl, alkenyl, alkynyl, arylalkyl, cycloalkyl, heteroalkyl, cycloalkylalkyl, heterocycloalkyl, cycloaryl, or heterocycloaryl, any of which is unsubstituted or substituted; or H; or part of a cyclic structure with a $D_a$ amino acid;
$R_{b7}$ is alkyl, alkenyl, alkynyl, arylalkyl, cycloalkyl, heteroalkyl, cycloalkylalkyl, heterocycloalkyl, cycloaryl, or heterocycloaryl, any of which is unsubstituted or substituted; or H; or part of a cyclic structure with a $D_b$ amino acid;
$R_{a8}$ is alkyl, alkenyl, alkynyl, arylalkyl, cycloalkyl, heteroalkyl, cycloalkylalkyl, heterocycloalkyl, cycloaryl, or heterocycloaryl, any of which is unsubstituted or substituted; or H; or part of a cyclic structure with an $E_a$ amino acid;
$R_{b8}$ is alkyl, alkenyl, alkynyl, arylalkyl, cycloalkyl, heteroalkyl, cycloalkylalkyl, heterocycloalkyl, cycloaryl, or heterocycloaryl, any of which is unsubstituted or substituted; or H; or an amino acid sequence of 1-1000 amino acid residues;

each va and vb is independently an integer from 0-1000;

each wa and wb is independently an integer from 0-1000;

each ua and ub is independently 0, 1, 2, 3, 4, 5, 6, 7, 8, 9, or 10, wherein ua+ub is at least 1;

each xa and xb is independently 0, 1, 2, 3, 4, 5, 6, 7, 8, 9, or 10;

each ya and yb is independently 0, 1, 2, 3, 4, 5, 6, 7, 8, 9, or 10;

each za and zb is independently 0, 1, 2, 3, 4, 5, 6, 7, 8, 9, or 10; and each n is independently 1, 2, 3, 4, or 5, or a pharmaceutically-acceptable salt thereof.

In some embodiments, the peptidomimetic macrocycle has the Formula (III) or Formula (IIIa):

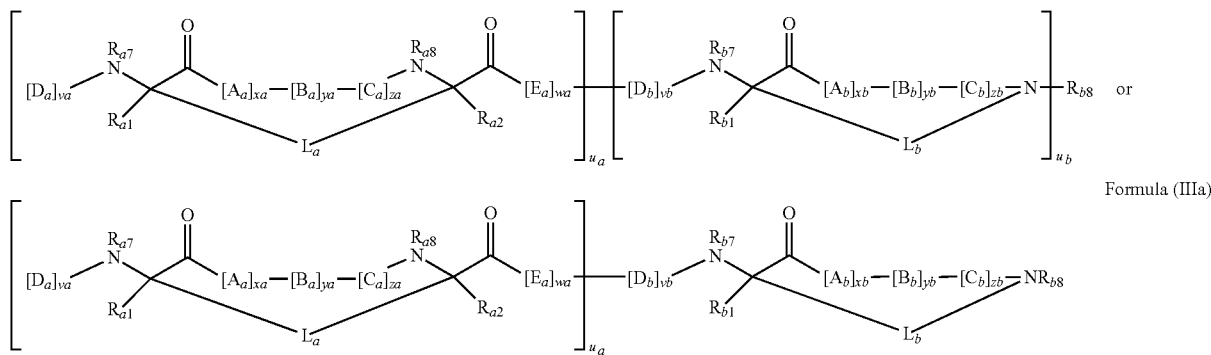

Formula (III)

Formula (IIIa)

wherein:
each $A_a$, $C_a$, $D_a$, $E_a$, $A_b$, $C_b$, and $D_b$ is independently a natural or non-natural amino acid or an amino acid analogue;

each $B_a$ and $B_b$ is independently a natural or non-natural amino acid, amino acid analog,

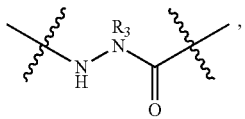

[—NH-$L_4$-CO—], [—NH-$L_4$-$SO_2$—], or [—NH-$L_4$-];

each $R_{a1}$ is independently alkyl, alkenyl, alkynyl, arylalkyl, cycloalkyl, cycloalkylalkyl, heteroalkyl, or heterocycloalkyl, any of which is unsubstituted or substituted; or H; or $R_{a1}$ forms a macrocycle-forming linker L' connected to the alpha position of one of the $D_a$ or $E_a$ amino acids; or together with $L_a$ forms a ring that is unsubstituted or substituted;

each $R_{a2}$ is independently alkyl, alkenyl, alkynyl, arylalkyl, cycloalkyl, cycloalkylalkyl, heteroalkyl, or heterocycloalkyl, any of which is unsubstituted or substituted; or H; or $R_{a2}$ forms a macrocycle-forming linker L' connected to the alpha position of one of the $D_a$ or $E_a$ amino acids; or together with $L_a$ forms a ring that is unsubstituted or substituted;

each $R_{b1}$ is independently alkyl, alkenyl, alkynyl, arylalkyl, cycloalkyl, cycloalkylalkyl, heteroalkyl, or heterocycloalkyl, any of which is unsubstituted or substituted; or H; or $R_{b1}$ forms a macrocycle-forming linker L' connected to the alpha position of one of the $D_b$ amino acids; or together with $L_b$ forms a ring that is unsubstituted or substituted;

each $R_3$ is independently alkyl, alkenyl, alkynyl, arylalkyl, heteroalkyl, cycloalkyl, heterocycloalkyl, cycloalkylalkyl, cycloaryl, or heterocycloaryl, any of which is unsubstituted or substituted with $R_5$, or H;

each $L_a$ is independently a macrocycle-forming linker, and optionally forms a ring with $R_{a1}$ or $R_{a2}$ that is unsubstituted or substituted;

each $L_b$ is independently a macrocycle-forming linker, and optionally forms a ring with $R_{b1}$ that is unsubstituted or substituted;

each L' is independently a macrocycle-forming linker;

each $L_4$ is independently alkylene, alkenylene, alkynylene, heteroalkylene, cycloalkylene, heterocycloalkylene, cycloarylene, heterocycloarylene, or [—$R_4$—K—$R_4$-]$_n$, any of which is unsubstituted or substituted with $R_5$;

each $R_4$ is independently alkylene, alkenylene, alkynylene, heteroalkylene, cycloalkylene, heterocycloalkylene, arylene, or heteroarylene, any of which is unsubstituted or substituted with $R_5$;

each K is independently O, S, SO, $SO_2$, CO, $CO_2$, $OCO_2$, $NR_3$, $CONR_3$, $OCONR_3$, $OSO_2NR_3$, $NR_{3q}$, $CONR_{3q}$, $OCONR_{3q}$, or $OSO_2NR_{3q}$, wherein each $R_{3q}$ is independently a point of attachment to $R_{a1}$, $R_{a2}$, or $R_{b1}$;

each $R_5$ is independently halogen, alkyl, —$OR_6$, —N($R_6$)$_2$, —$SR_6$, —$SOR_6$, —$SO_2R_6$, —$CO_2R_6$, a fluorescent moiety, a radioisotope, or a therapeutic agent;

each $R_6$ is independently H, alkyl, alkenyl, alkynyl, arylalkyl, cycloalkylalkyl, heterocycloalkyl, a fluorescent moiety, a radioisotope or a therapeutic agent;

each $R_{a7}$ is independently alkyl, alkenyl, alkynyl, arylalkyl, cycloalkyl, heteroalkyl, cycloalkylalkyl, heterocycloalkyl, cycloaryl, or heterocycloaryl, any of which is unsubstituted or substituted with $R_5$; or H; or part of a cyclic structure with a $D_a$ amino acid;

$R_{b7}$ is alkyl, alkenyl, alkynyl, arylalkyl, cycloalkyl, heteroalkyl, cycloalkylalkyl, heterocycloalkyl, cycloaryl, or heterocycloaryl, any of which is unsubstituted or substituted with $R_5$; or H; or part of a cyclic structure with a $D_b$ amino acid;

each $R_{a8}$ is independently alkyl, alkenyl, alkynyl, arylalkyl, cycloalkyl, heteroalkyl, cycloalkylalkyl, heterocycloalkyl, cycloaryl, or heterocycloaryl, any of which is unsubstituted or substituted with $R_5$; or H; or part of a cyclic structure with an $E_a$ amino acid;

$R_{b8}$ is alkyl, alkenyl, alkynyl, arylalkyl, cycloalkyl, heteroalkyl, cycloalkylalkyl, heterocycloalkyl, cycloaryl, or heterocycloaryl, any of which is unsubstituted or substituted with $R_5$; or H; or an amino acid sequence of 1-1000 amino acid residues;

each va and vb is independently an integer from 0-1000;

each wa and wb is independently an integer from 0-1000;

each ua and ub is independently 0, 1, 2, 3, 4, 5, 6, 7, 8, 9, or 10, wherein ua+ub is at least 1;

each xa and xb is independently 0, 1, 2, 3, 4, 5, 6, 7, 8, 9, or 10;

each ya and yb is independently 0, 1, 2, 3, 4, 5, 6, 7, 8, 9, or 10;

each za and zb is independently 0, 1, 2, 3, 4, 5, 6, 7, 8, 9, or 10; and each n is independently 1, 2, 3, 4, or 5, or a pharmaceutically-acceptable salt thereof.

In some embodiments, the peptidomimetic macrocycle of the invention has the formula defined above, wherein:

each $L_a$ is independently a macrocycle-forming linker of the formula $-L_1-L_2-$, and optionally forms a ring with $R_{a1}$ or $R_{a2}$ that is unsubstituted or substituted;

each $L_b$ is independently a macrocycle-forming linker of the formula $-L_1-L_2-$, and optionally forms a ring with $R_{b1}$ that is unsubstituted or substituted;

each L' is independently a macrocycle-forming linker of the formula $-L_1-L_2-$;

each $L_1$ and $L_2$ is independently alkylene, alkenylene, alkynylene, heteroalkylene, cycloalkylene, heterocycloalkylene, cycloarylene, heterocycloarylene, or $[-R_4-K-R_4-]_n$, any of which is unsubstituted or substituted with $R_5$;

each $R_4$ is independently alkylene, alkenylene, alkynylene, heteroalkylene, cycloalkylene, heterocycloalkylene, arylene, or heteroarylene, any of which is unsubstituted or substituted with $R_5$;

each K is independently O, S, SO, $SO_2$, CO, $CO_2$, $OCO_2$, $NR_3$, $CONR_3$, $OCONR_3$, $OSO_2NR_3$, $NR_{3q}$, $CONR_{3q}$, $OCONR_{3q}$, or $OSO_2NR_{3q}$, wherein each $R_{3q}$ is independently a point of attachment to $R_{a1}$, $R_{a2}$, or $R_{b1}$;

each $R_5$ is independently halogen, alkyl, $-OR_6$, $-N(R_6)_2$, $-SR_6$, $-SOR_6$, $-SO_2R_6$, $-CO_2R_6$, a fluorescent moiety, a radioisotope, or a therapeutic agent; and each $R_6$ is independently H, alkyl, alkenyl, alkynyl, arylalkyl, cycloalkylalkyl, heterocycloalkyl, a fluorescent moiety, a radioisotope or a therapeutic agent, or a pharmaceutically-acceptable salt thereof.

In some embodiments, the peptidomimetic macrocycle has the formula defined above wherein one of $L_a$ and $L_b$ is a bis-thioether-containing macrocycle-forming linker. In some embodiments, one of $L_a$ and $L_b$ is a macrocycle-forming linker of the formula $-L_1-S-L_2-S-L_3-$.

In some embodiments, the peptidomimetic macrocycle has the formula defined above wherein one of $L_a$ and $L_b$ is a bis-sulfone-containing macrocycle-forming linker. In some embodiments, one of $L_a$ and $L_b$ is a macrocycle-forming linker of the formula $-L_1-SO_2-L_2-SO_2-L_3-$.

In some embodiments, the peptidomimetic macrocycle has the formula defined above wherein one of $L_a$ and $L_b$ is a bis-sulfoxide-containing macrocycle-forming linker. In some embodiments, one of $L_a$ and $L_b$ is a macrocycle-forming linker of the formula $-L_1-S(O)-L_2-S(O)-L_3-$.

In some embodiments, a peptidomimetic macrocycle of the invention comprises one or more secondary structures.

In some embodiments, the peptidomimetic macrocycle comprises a secondary structure that is an α-helix. In some embodiments, the peptidomimetic macrocycle comprises a secondary structure that is a β-hairpin turn.

In some embodiments, $u_a$ is 0. In some embodiments, $u_a$ is 0, and $L_b$ is a macrocycle-forming linker that crosslinks an α-helical secondary structure. In some embodiments, $u_a$ is 0, and $L_b$ is a macrocycle-forming linker that crosslinks a β-hairpin secondary structure. In some embodiments, $u_a$ is 0, and $L_b$ is a hydrocarbon-containing macrocycle-forming linker that crosslinks an α-helical secondary structure. In some embodiments, $u_a$ is 0, and $L_b$ is a hydrocarbon-containing macrocycle-forming linker that crosslinks a β-hairpin secondary structure.

In some embodiments, ub is 0. In some embodiments, Ub is 0, and $L_a$ is a macrocycle-forming linker that crosslinks an α-helical secondary structure. In some embodiments, $u_b$ is 0, and $L_a$ is a macrocycle-forming linker that crosslinks a β-hairpin secondary structure. In some embodiments, $u_b$ is 0, and $L_a$ is a hydrocarbon-containing macrocycle-forming linker that crosslinks an α-helical secondary structure. In some embodiments, ub is 0, and $L_a$ is a hydrocarbon-containing macrocycle-forming linker that crosslinks a β-hairpin secondary structure.

In some embodiments, the peptidomimetic macrocycle comprises only α-helical secondary structures. In other embodiments, the peptidomimetic macrocycle comprises only β-hairpin secondary structures.

In other embodiments, the peptidomimetic macrocycle comprises a combination of secondary structures, wherein the secondary structures are α-helical and β-hairpin structures. In some embodiments, $L_a$ and $L_b$ are a combination of hydrocarbon-, triazole, or sulfur-containing macrocycle-forming linkers. In some embodiments, the peptidomimetic macrocycle comprises $L_a$ and $L_b$, wherein $L_a$ is a hydrocarbon-containing macrocycle-forming linker that crosslinks a β-hairpin structure, and $L_b$ is a triazole-containing macrocycle-forming linker that crosslinks an α-helical structure. In some embodiments, the peptidomimetic macrocycle comprises $L_a$ and $L_b$, wherein $L_a$ is a hydrocarbon-containing macrocycle-forming linker that crosslinks an α-helical structure, and $L_b$ is a triazole-containing macrocycle-forming linker that crosslinks a β-hairpin structure. In some embodiments, the peptidomimetic macrocycle comprises $L_a$ and $L_b$, wherein $L_a$ is a triazole-containing macrocycle-forming linker that crosslinks an α-helical structure, and $L_b$ is a hydrocarbon-containing macrocycle-forming linker that crosslinks a β-hairpin structure. In some embodiments, the peptidomimetic macrocycle comprises $L_a$ and $L_b$, wherein $L_a$ is a triazole-containing macrocycle-forming linker that crosslinks a β-hairpin structure, and $L_b$ is a hydrocarbon-containing macrocycle-forming linker that crosslinks an α-helical structure.

In some embodiments, $u_a+u_b$ is at least 1. In some embodiments, $u_a+u_b=2$.

In some embodiments, $u_a$ is 1, $u_b$ is 1, $L_a$ is a triazole-containing macrocycle-forming linker that crosslinks an α-helical secondary structure, and $L_b$ is a hydrocarbon-containing macrocycle-forming linker that crosslinks an α-helical structure. In some embodiments, $u_a$ is 1, $u_b$ is 1, $L_a$ is a triazole-containing macrocycle-forming linker that crosslinks an α-helical secondary structure, and $L_b$ is a hydrocarbon-containing macrocycle-forming linker that crosslinks a β-hairpin structure. In some embodiments, $u_a$ is 1, ub is 1, $L_a$ is a triazole-containing macrocycle-forming linker that crosslinks a β-hairpin secondary structure, and $L_b$ is a hydrocarbon-containing macrocycle-forming linker that crosslinks an α-helical structure. In some embodiments, $u_a$ is 1, $u_b$ is 1, $L_a$ is a triazole-containing macrocycle-forming linker that crosslinks a β-hairpin secondary structure, and $L_b$ is a hydrocarbon-containing macrocycle-forming linker that crosslinks a β-hairpin structure.

In some embodiments, $u_a$ is 1, $u_b$ is 1, $L_a$ is a hydrocarbon-containing macrocycle-forming linker that crosslinks an α-helical secondary structure, and $L_b$ is a triazole-containing macrocycle-forming linker that crosslinks an α-helical secondary structure. In some embodiments, $u_a$ is 1, ub is 1, $L_a$ is a hydrocarbon-containing macrocycle-forming linker that crosslinks an α-helical secondary structure, and $L_b$ is a triazole-containing macrocycle-forming linker that crosslinks a β-hairpin secondary structure. In some embodiments, $u_a$ is 1, ub is 1, $L_a$ is a hydrocarbon-containing macrocycle-forming linker that crosslinks a β-hairpin secondary structure, and $L_b$ is a triazole-containing macrocycle-forming linker that crosslinks an α-helical secondary structure. In some embodiments, $u_a$ is 1, $u_b$ is 1, $L_a$ is a hydrocarbon-containing macrocycle-forming linker that crosslinks a β-hairpin secondary structure, and $L_b$ is a triazole-containing macrocycle-forming linker that crosslinks a β-hairpin secondary structure.

In some embodiments, $u_a$ is 1, $u_b$ is 1, $L_a$ is a hydrocarbon-containing macrocycle-forming linker with an α-helical secondary structure, and $L_b$ is a sulfur-containing macrocycle-forming linker. In some embodiments, $u_a$ is 1, $u_b$ is 1, $L_a$ is a hydrocarbon-containing macrocycle-forming linker with a β-hairpin secondary structure, and $L_b$ is a sulfur-containing macrocycle-forming linker.

In some embodiments, u, is 1, $u_b$ is 1, $L_a$ is a sulfur-containing macrocycle-forming linker, and $L_b$ is a hydrocarbon-containing macrocycle-forming linker with an α-helical secondary structure. In some embodiments, u, is 1, ub is 1, $L_a$ is a sulfur-containing macrocycle-forming linker, and $L_b$ is a hydrocarbon-containing macrocycle-forming linker with a β-hairpin secondary structure.

In some embodiments, $u_a$ is 1, $u_b$ is 1, $L_a$ is a hydrocarbon-containing macrocycle-forming linker that crosslinks an α-helical structure, and $L_b$ is a hydrocarbon-containing macrocycle-forming linker that crosslinks an α-helical structure. In some embodiments, $u_a$ is 1, $u_b$ is 1, $L_a$ is a hydrocarbon-containing macrocycle-forming linker that crosslinks an α-helical structure, and $L_b$ is a hydrocarbon-containing macrocycle-forming linker that crosslinks a β-hairpin structure. In some embodiments, $u_a$ is 1, $u_b$ is 1, $L_a$ is a hydrocarbon-containing macrocycle-forming linker that crosslinks a β-hairpin structure, and $L_b$ is a hydrocarbon-containing macrocycle-forming linker that crosslinks an α-helical structure. In some embodiments, $u_a$ is 1, $u_b$ is 1, $L_a$ is a hydrocarbon-containing macrocycle-forming linker that crosslinks a β-hairpin structure, and $L_b$ is a hydrocarbon-containing macrocycle-forming linker that crosslinks a β-hairpin structure.

In some embodiments, $R_{b1}$ is H.

Unless otherwise stated, any compounds (including peptidomimetic macrocycles, macrocycle precursors, and other compositions) are also meant to encompass compounds which differ only in the presence of one or more isotopically enriched atoms. For example, compounds having the described structures except for the replacement of a hydrogen atom by deuterium or tritium, or the replacement of a carbon atom by $^{13}C$ or $^{14}C$ are contemplated.

In some embodiments, the compounds disclosed herein can contain unnatural proportions of atomic isotopes at one or more of atoms that constitute such compounds. For example, the compounds can be radiolabeled with radioactive isotopes, such as for example tritium ($^3H$), iodine-125 ($^{125}I$) or carbon-14 ($^{14}C$). In other embodiments, one or more carbon atoms is replaced with a silicon atom. All isotopic variations of the compounds disclosed herein, whether radioactive or not, are contemplated herein.

In some embodiments, the peptidomimetic macrocycle comprises an amino acid sequence that is at least 60%, at least 65%, at least 70%, at least 75%, at least 80%, at least 85%, at least 90%, or at least 95% identical to an amino acid sequence listed in Table 1, Table 1a, Table 1b, Table 1c, Table 2a, Table 2b, Table 3, or Table 3a. In some embodiments, the peptidomimetic macrocycle comprises an amino acid sequence that is at least 60% identical to an amino acid sequence listed in Table 1, Table 1a, Table 1b, Table 1c, Table 2a, Table 2b, Table 3, or Table 3a. In some embodiments, the peptidomimetic macrocycle comprises an amino acid sequence that is at least 65% identical to an amino acid sequence listed in Table 1, Table 1a, Table 1b, Table 1c, Table 2a, Table 2b, Table 3, or Table 3a. In some embodiments, the peptidomimetic macrocycle comprises an amino acid sequence that is at least 70% identical to an amino acid sequence listed in Table 1, Table 1a, Table 1b, Table 1c, Table 2a, Table 2b, Table 3, or Table 3a. In some embodiments, the peptidomimetic macrocycle comprises an amino acid sequence that is at least 75% identical to an amino acid sequence listed in Table 1, Table 1a, Table 1b, Table 1c, Table 2a, Table 2b, Table 3, or Table 3a.

In some embodiments, the peptidomimetic macrocycle is at least 60%, at least 65%, at least 70%, at least 75%, at least 80%, at least 85%, at least 90%, or at least 95% identical to an amino acid sequence listed in Table 1, Table 1a, Table 1b, Table 1c, Table 2a, Table 2b, Table 3, or Table 3a. In some embodiments, the peptidomimetic macrocycle is at least 60% identical to an amino acid sequence listed in Table 1, Table 1a, Table 1b, Table 1c, Table 2a, Table 2b, Table 3, or Table 3a. In some embodiments, the peptidomimetic macrocycle is at least 65% identical to an amino acid sequence listed in Table 1, Table 1a, Table 1b, Table 1c, Table 2a, Table 2b, Table 3, or Table 3a. In some embodiments, the peptidomimetic macrocycle is at least 70% identical to an amino acid sequence listed in Table 1, Table 1a, Table 1b, Table 1c, Table 2a, Table 2b, Table 3, or Table 3a. In some embodiments, the peptidomimetic macrocycle is at least 75% identical to an amino acid sequence listed in Table 1, Table 1a, Table 1b, Table 1c, Table 2a, Table 2b, Table 3, or Table 3a.

Preparation of Peptidomimetic Macrocycles

Peptidomimetic macrocycles can be prepared by any of a variety of methods known in the art. For example, any of the residues indicated by "$" or "$r8" in Table 1, Table 1a, Table 1b, Table 1c, Table 2a, Table 2b, Table 3, or Table 3a can be substituted with a residue capable of forming a crosslinker with a second residue in the same molecule or a precursor of such a residue.

α,α-Disubstituted amino acids and amino acid precursors can be employed in synthesis of the peptidomimetic macrocycle precursor polypeptides. For example, the "S5-olefin amino acid" is (S)-α-(2'-pentenyl) alanine and the "R8 olefin amino acid" is (R)-α-(2'-octenyl) alanine. Following incorporation of such amino acids into precursor polypeptides, the terminal olefins are reacted with a metathesis catalyst, leading to the formation of the peptidomimetic macrocycle. In various embodiments, the following amino acids can be employed in the synthesis of the peptidomimetic macrocycle:

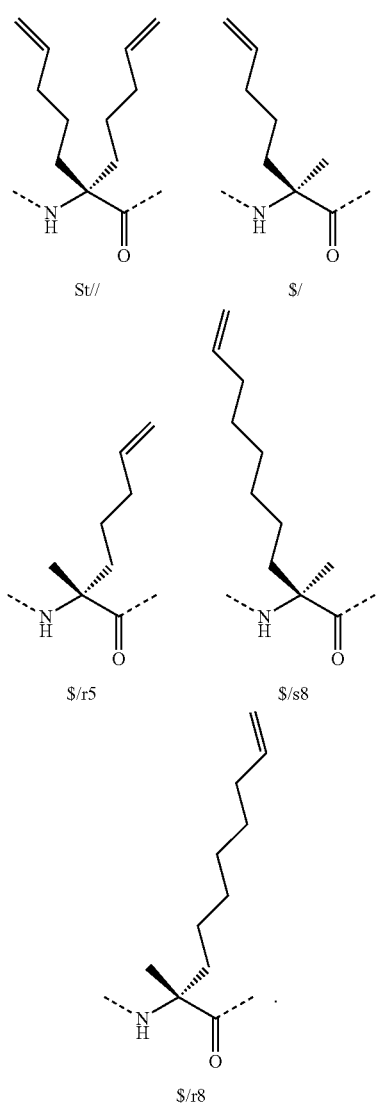

In other embodiments, the peptidomimetic macrocycles are of Formula IV or IVa. In such embodiments, amino acid precursors are used containing an additional substituent R— at the alpha position. Such amino acids are incorporated into the macrocycle precursor at the desired positions, which can be at the positions where the crosslinker is substituted or, alternatively, elsewhere in the sequence of the macrocycle precursor. Cyclization of the precursor is then effected according to the indicated method.

Pharmaceutically-Acceptable Salts

The invention provides the use of pharmaceutically-acceptable salts of any therapeutic compound described herein. Pharmaceutically-acceptable salts include, for example, acid-addition salts and base-addition salts. The acid that is added to the compound to form an acid-addition salt can be an organic acid or an inorganic acid. A base that is added to the compound to form a base-addition salt can be an organic base or an inorganic base. In some embodiments, a pharmaceutically-acceptable salt is a metal salt. In some embodiments, a pharmaceutically-acceptable salt is an ammonium salt.

Metal salts can arise from the addition of an inorganic base to a compound of the invention. The inorganic base consists of a metal cation paired with a basic counterion, such as, for example, hydroxide, carbonate, bicarbonate, or phosphate. The metal can be an alkali metal, alkaline earth metal, transition metal, or main group metal. In some embodiments, the metal is lithium, sodium, potassium, cesium, cerium, magnesium, manganese, iron, calcium, strontium, cobalt, titanium, aluminum, copper, cadmium, or zinc.

In some embodiments, a metal salt is a lithium salt, a sodium salt, a potassium salt, a cesium salt, a cerium salt, a magnesium salt, a manganese salt, an iron salt, a calcium salt, a strontium salt, a cobalt salt, a titanium salt, an aluminum salt, a copper salt, a cadmium salt, or a zinc salt.

Ammonium salts can arise from the addition of ammonia or an organic amine to a compound of the invention. In some embodiments, the organic amine is triethyl amine, diisopropyl amine, ethanol amine, diethanol amine, triethanol amine, morpholine, N-methylmorpholine, piperidine, N-methylpiperidine, N-ethylpiperidine, dibenzylamine, piperazine, pyridine, pyrrazole, pipyrrazole, imidazole, pyrazine, or pipyrazine.

In some embodiments, an ammonium salt is a triethyl amine salt, a diisopropyl amine salt, an ethanol amine salt, a diethanol amine salt, a triethanol amine salt, a morpholine salt, an N-methylmorpholine salt, a piperidine salt, an N-methylpiperidine salt, an N-ethylpiperidine salt, a dibenzylamine salt, a piperazine salt, a pyridine salt, a pyrrazole salt, a pipyrrazole salt, an imidazole salt, a pyrazine salt, or a pipyrazine salt.

Acid addition salts can arise from the addition of an acid to a compound of the invention. In some embodiments, the acid is organic. In some embodiments, the acid is inorganic. In some embodiments, the acid is hydrochloric acid, hydrobromic acid, hydroiodic acid, nitric acid, nitrous acid, sulfuric acid, sulfurous acid, a phosphoric acid, isonicotinic acid, lactic acid, salicylic acid, tartaric acid, ascorbic acid, gentisinic acid, gluconic acid, glucaronic acid, saccaric acid, formic acid, benzoic acid, glutamic acid, pantothenic acid, acetic acid, propionic acid, butyric acid, fumaric acid, succinic acid, methanesulfonic acid, ethanesulfonic acid, benzenesulfonic acid, p-toluenesulfonic acid, citric acid, oxalic acid, or maleic acid. Examples of suitable acid salts include acetate, adipate, benzoate, benzenesulfonate, butyrate, citrate, digluconate, dodecylsulfate, formate, fumarate, glycolate, hemisulfate, heptanoate, hexanoate, hydrochloride, hydrobromide, hydroiodide, lactate, maleate, malonate, methanesulfonate, 2-naphthalenesulfonate, nicotinate, nitrate, palmoate, phosphate, picrate, pivalate, propionate, salicylate, succinate, sulfate, tartrate, tosylate and undecanoate. Salts derived from appropriate bases include alkali metal (e.g., sodium), alkaline earth metal (e.g., magnesium), ammonium and N-(alkyl)$_4^+$ salts.

In some embodiments, the salt is a hydrochloride salt, a hydrobromide salt, a hydroiodide salt, a nitrate salt, a nitrite salt, a sulfate salt, a sulfite salt, a phosphate salt, isonicotinate salt, a lactate salt, a salicylate salt, a tartrate salt, an ascorbate salt, a gentisinate salt, a gluconate salt, a glucaronate salt, a saccarate salt, a formate salt, a benzoate salt, a glutamate salt, a pantothenate salt, an acetate salt, a propionate salt, a butyrate salt, a fumarate salt, a succinate salt, a methanesulfonate (mesylate) salt, an ethanesulfonate salt, a benzenesulfonate salt, a p-toluenesulfonate salt, a citrate salt, an oxalate salt, or a maleate salt.

Purity of Compounds of the Invention

Any compound herein can be purified. A compound herein can be least 1% pure, at least 2% pure, at least 3% pure, at least 4% pure, at least 5% pure, at least 6% pure, at least 7% pure, at least 8% pure, at least 9% pure, at least 10% pure, at least 11% pure, at least 12% pure, at least 13% pure, at least 14% pure, at least 15% pure, at least 16% pure, at least 17% pure, at least 18% pure, at least 19% pure, at least 20% pure, at least 21% pure, at least 22% pure, at least 23% pure, at least 24% pure, at least 25% pure, at least 26% pure, at least 27% pure, at least 28% pure, at least 29% pure, at least 30% pure, at least 31% pure, at least 32% pure, at least 33% pure, at least 34% pure, at least 35% pure, at least 36% pure, at least 37% pure, at least 38% pure, at least 39% pure, at least 40% pure, at least 41% pure, at least 42% pure, at least 43% pure, at least 44% pure, at least 45% pure, at least 46% pure, at least 47% pure, at least 48% pure, at least 49% pure, at least 50% pure, at least 51% pure, at least 52% pure, at least 53% pure, at least 54% pure, at least 55% pure, at least 56% pure, at least 57% pure, at least 58% pure, at least 59% pure, at least 60% pure, at least 61% pure, at least 62% pure, at least 63% pure, at least 64% pure, at least 65% pure, at least 66% pure, at least 67% pure, at least 68% pure, at least 69% pure, at least 70% pure, at least 71% pure, at least 72% pure, at least 73% pure, at least 74% pure, at least 75% pure, at least 76% pure, at least 77% pure, at least 78% pure, at least 79% pure, at least 80% pure, at least 81% pure, at least 82% pure, at least 83% pure, at least 84% pure, at least 85% pure, at least 86% pure, at least 87% pure, at least 88% pure, at least 89% pure, at least 90% pure, at least 91% pure, at least 92% pure, at least 93% pure, at least 94% pure, at least 95% pure, at least 96% pure, at least 97% pure, at least 98% pure, at least 99% pure, at least 99.1% pure, at least 99.2% pure, at least 99.3% pure, at least 99.4% pure, at least 99.5% pure, at least 99.6% pure, at least 99.7% pure, at least 99.8% pure, or at least 99.9% pure.

Formulation and Administration

Pharmaceutical Compositions

Pharmaceutical compositions disclosed herein include peptidomimetic macrocycles and pharmaceutically-acceptable derivatives or prodrugs thereof. A "pharmaceutically-acceptable derivative" means any pharmaceutically-acceptable salt, ester, salt of an ester, pro-drug or other derivative of a compound disclosed herein which, upon administration to a recipient, is capable of providing (directly or indirectly) a compound disclosed herein. Particularly favored pharmaceutically-acceptable derivatives are those that increase the bioavailability of the compounds when administered to a mammal (e.g., by increasing absorption into the blood of an orally administered compound) or which increases delivery of the active compound to a biological compartment (e.g., the brain or lymphatic system) relative to the parent species. Some pharmaceutically-acceptable derivatives include a chemical group which increases aqueous solubility or active transport across the gastrointestinal mucosa.

In some embodiments, peptidomimetic macrocycles are modified by covalently or non-covalently joining appropriate functional groups to enhance selective biological properties. Such modifications include those which increase biological penetration into a given biological compartment (e.g., blood, lymphatic system, central nervous system), increase oral availability, increase solubility to allow administration by injection, alter metabolism, and alter rate of excretion.

For preparing pharmaceutical compositions from the compounds disclosed herein, pharmaceutically-acceptable carriers include either solid or liquid carriers. Solid form preparations include powders, tablets, pills, capsules, cachets, suppositories, and dispersible granules. A solid carrier can be one or more substances, which also acts as diluents, flavoring agents, binders, preservatives, tablet disintegrating agents, or an encapsulating material.

In powders, the carrier is a finely divided solid, which is in a mixture with the finely divided active component. In tablets, the active component is mixed with the carrier having the necessary binding properties in suitable proportions and compacted in the shape and size desired.

Suitable solid excipients are carbohydrate or protein fillers include, but are not limited to sugars, including lactose, sucrose, mannitol, or sorbitol; starch from corn, wheat, rice, potato, or other plants; cellulose such as methyl cellulose, hydroxypropylmethyl-cellulose, or sodium carboxymethyl-cellulose; and gums including arabic and tragacanth; as well as proteins such as gelatin and collagen. If desired, disintegrating or solubilizing agents are added, such as the cross-linked polyvinyl pyrrolidone, agar, alginic acid, or a salt thereof, such as sodium alginate.

Liquid form preparations include solutions, suspensions, and emulsions, for example, water or water/propylene glycol solutions. For parenteral injection, liquid preparations can be formulated in solution in aqueous polyethylene glycol solution.

The pharmaceutical preparation can be in unit dosage form. In such form the preparation is subdivided into unit doses containing appropriate quantities of the active component. The unit dosage form can be a packaged preparation, the package containing discrete quantities of preparation, such as packaged tablets, capsules, and powders in vials or ampoules. Also, the unit dosage form can be a capsule, tablet, cachet, or lozenge itself, or it can be the appropriate number of any of these in packaged form.

When one or more compositions disclosed herein comprise a combination of a peptidomimetic macrocycle and one or more additional therapeutic or prophylactic agents, both the compound and the additional agent should be present at dosage levels of between about 1 to 100%, and more preferably between about 5 to 95% of the dosage normally administered in a monotherapy regimen. In some embodiments, the additional agents are administered separately, as part of a multiple dose regimen, from one or more compounds disclosed herein. Alternatively, those agents are part of a single dosage form, mixed together with the compounds disclosed herein in a single composition.

In some embodiments, a pharmaceutical composition disclosed herein comprises a peptidomimetic macrocylce at a concentration of about 5 mg/mL to about 50 mg/mL. In some embodiments, a pharmaceutical composition disclosed herein comprises a peptidomimetic macrocylce at a concentration of about 5 mg/mL to about 10 mg/mL, about 5 mg/mL to about 15 mg/mL, about 5 mg/mL to about 20 mg/mL, about 5 mg/mL to about 30 mg/mL, about 5 mg/mL to about 40 mg/mL, about 5 mg/mL to about 50 mg/mL, about 10 mg/mL to about 15 mg/mL, about 10 mg/mL to about 20 mg/mL, about 10 mg/mL to about 30 mg/mL, about 10 mg/mL to about 40 mg/mL, about 10 mg/mL to about 50 mg/mL, about 15 mg/mL to about 20 mg/mL, about 15 mg/mL to about 30 mg/mL, about 15 mg/mL to about 40 mg/mL, about 15 mg/mL to about 50 mg/mL, about 20 mg/mL to about 30 mg/mL, about 20 mg/mL to about 40 mg/mL, about 20 mg/mL to about 50 mg/mL, about 30 mg/mL to about 40 mg/mL, about 30 mg/mL to about 50 mg/mL, or about 40 mg/mL to about 50 mg/mL. In some embodiments, a pharmaceutical composition disclosed herein comprises a peptidomimetic macrocylce at a concentration of about 5 mg/mL, about 10 mg/mL, about 15 mg/mL, about 20 mg/mL, about 30 mg/mL, about 40 mg/mL, or about 50 mg/mL. In some embodiments, a pharmaceutical composition disclosed herein comprises a peptidomimetic macrocylce at a concentration of at least about 5 mg/mL, about 10 mg/mL, about 15 mg/mL, about 20 mg/mL, about 30 mg/mL, or about 40 mg/mL. In some embodiments, a pharmaceutical composition disclosed herein comprises a peptidomimetic macrocylce at a concentration of at most about 10 mg/mL, about 15 mg/mL, about 20 mg/mL, about 30 mg/mL, about 40 mg/mL, or about 50 mg/mL.

In some embodiments, a pharmaceutical composition disclosed herein comprises trehalose. In some embodiments, the concentration of trehalose in a pharmaceutical composition disclosed herein is about 10 mg/mL to about 500 mg/mL. In some embodiments, the concentration of trehalose in a pharmaceutical composition disclosed herein is about 10 mg/mL to about 20 mg/mL, about 10 mg/mL to about 30 mg/mL, about 10 mg/mL to about 40 mg/mL, about 10 mg/mL to about 50 mg/mL, about 10 mg/mL to about 60 mg/mL, about 10 mg/mL to about 70 mg/mL, about 10 mg/mL to about 80 mg/mL, about 10 mg/mL to about 90 mg/mL, about 10 mg/mL to about 100 mg/mL, about 10 mg/mL to about 250 mg/mL, about 10 mg/mL to about 500 mg/mL, about 20 mg/mL to about 30 mg/mL, about 20 mg/mL to about 40 mg/mL, about 20 mg/mL to about 50 mg/mL, about 20 mg/mL to about 60 mg/mL, about 20 mg/mL to about 70 mg/mL, about 20 mg/mL to about 80 mg/mL, about 20 mg/mL to about 90 mg/mL, about 20 mg/mL to about 100 mg/mL, about 20 mg/mL to about 250 mg/mL, about 20 mg/mL to about 500 mg/mL, about 30 mg/mL to about 40 mg/mL, about 30 mg/mL to about 50 mg/mL, about 30 mg/mL to about 60 mg/mL, about 30 mg/mL to about 70 mg/mL, about 30 mg/mL to about 80 mg/mL, about 30 mg/mL to about 90 mg/mL, about 30 mg/mL to about 100 mg/mL, about 30 mg/mL to about 250 mg/mL, about 30 mg/mL to about 500 mg/mL, about 40 mg/mL to about 50 mg/mL, about 40 mg/mL to about 60 mg/mL, about 40 mg/mL to about 70 mg/mL, about 40 mg/mL to about 80 mg/mL, about 40 mg/mL to about 90 mg/mL, about 40 mg/mL to about 100 mg/mL, about 40 mg/mL to about 250 mg/mL, about 40 mg/mL to about 500 mg/mL, about 50 mg/mL to about 60 mg/mL, about 50 mg/mL to about 70 mg/mL, about 50 mg/mL to about 80 mg/mL, about 50 mg/mL to about 90 mg/mL, about 50 mg/mL to about 100 mg/mL, about 50 mg/mL to about 250 mg/mL, about 50 mg/mL to about 500 mg/mL, about 60 mg/mL to about 70 mg/mL, about 60 mg/mL to about 80 mg/mL, about 60 mg/mL to about 90 mg/mL, about 60 mg/mL to about 100 mg/mL, about 60 mg/mL to about 250 mg/mL, about 60 mg/mL to about 500 mg/mL, about 70 mg/mL to about 80 mg/mL, about 70 mg/mL to about 90 mg/mL, about 70 mg/mL to about 100 mg/mL, about 70 mg/mL to about 250 mg/mL, about 70 mg/mL to about 500 mg/mL, about 80 mg/mL to about 90 mg/mL, about 80 mg/mL to about 100 mg/mL, about 80 mg/mL to about 250 mg/mL, about 80 mg/mL to about 500 mg/mL, about 90 mg/mL to about 100 mg/mL, about 90 mg/mL to about 250 mg/mL, about 90 mg/mL to about 500 mg/mL, about 100 mg/mL to about 250 mg/mL, about 100 mg/mL to about 500 mg/mL, or about 250 mg/mL to about 500 mg/mL. In some embodiments, the concentration of trehalose in a pharmaceutical composition disclosed herein is about 10 mg/mL, about 20 mg/mL, about 30 mg/mL, about 40 mg/mL, about 50 mg/mL, about 60 mg/mL, about 70 mg/mL, about 80 mg/mL, about 90 mg/mL, about 100 mg/mL, about 250 mg/mL, or about 500 mg/mL. In some embodiments, the concentration of trehalose in a pharmaceutical composition disclosed herein is at least about 10 mg/mL, about 20 mg/mL, about 30 mg/mL, about 40 mg/mL, about 50 mg/mL, about 60 mg/mL, about 70 mg/mL, about 80 mg/mL, about 90 mg/mL, about 100 mg/mL, or about 250 mg/mL. In some embodiments, the concentration of trehalose in a pharmaceutical composition disclosed herein is at most about 20 mg/mL, about 30 mg/mL, about 40 mg/mL, about 50 mg/mL, about 60 mg/mL, about 70 mg/mL, about 80 mg/mL, about 90 mg/mL, about 100 mg/mL, about 250 mg/mL, or about 500 mg/mL.

In some embodiments, the concentration of trehalose in a pharmaceutical composition disclosed herein is about 100 mM to about 500 mM. In some embodiments, the concentration of trehalose in a pharmaceutical composition disclosed herein is about 100 mM to about 200 mM, about 100 mM to about 220 mM, about 100 mM to about 240 mM, about 100 mM to about 260 mM, about 100 mM to about 280 mM, about 100 mM to about 300 mM, about 100 mM to about 350 mM, about 100 mM to about 400 mM, about 100 mM to about 450 mM, about 100 mM to about 500 mM, about 200 mM to about 220 mM, about 200 mM to about 240 mM, about 200 mM to about 260 mM, about 200 mM to about 280 mM, about 200 mM to about 300 mM, about 200 mM to about 350 mM, about 200 mM to about 400 mM, about 200 mM to about 450 mM, about 200 mM to about 500 mM, about 220 mM to about 240 mM, about 220 mM to about 260 mM, about 220 mM to about 280 mM, about 220 mM to about 300 mM, about 220 mM to about 350 mM, about 220 mM to about 400 mM, about 220 mM to about 450 mM, about 220 mM to about 500 mM, about 240 mM to about 260 mM, about 240 mM to about 280 mM, about 240 mM to about 300 mM, about 240 mM to about 350 mM, about 240 mM to about 400 mM, about 240 mM to about 450 mM, about 240 mM to about 500 mM, about 260 mM to about 280 mM, about 260 mM to about 300 mM, about 260 mM to about 350 mM, about 260 mM to about 400 mM, about 260 mM to about 450 mM, about 260 mM to about 500 mM, about 280 mM to about 300 mM, about 280 mM to about 350 mM, about 280 mM to about 400 mM, about 280 mM to about 450 mM, about 280 mM to about 500 mM, about 300 mM to about 350 mM, about 300 mM to about 400 mM, about 300 mM to about 450 mM, about 300 mM to about 500 mM, about 350 mM to about 400 mM, about 350 mM to about 450 mM, about 350 mM to about 500 mM, about 400 mM to about 450 mM, about 400 mM to about 500 mM, or about 450 mM to about 500 mM. In some embodiments, the concentration of trehalose in a pharmaceutical composition disclosed herein is about 100 mM, about 200 mM, about 220 mM, about 240 mM, about 260 mM, about 280 mM, about 300 mM, about 350 mM, about 400 mM, about 450 mM, or about 500 mM. In some embodiments, the concentration of trehalose in a pharmaceutical composition disclosed herein is at least about 100 mM, about 200 mM, about 220 mM, about 240 mM, about 260 mM, about 280 mM, about 300 mM, about 350 mM, about 400 mM, or about 450 mM. In some embodiments, the concentration of trehalose in a pharmaceutical composition disclosed herein is at most about 200 mM, about 220 mM, about 240 mM, about 260 mM, about 280 mM, about 300 mM, about 350 mM, about 400 mM, about 450 mM, or about 500 mM.

In some embodiments, a pharmaceutical composition disclosed herein comprises a tonicity adjusting agent. In some embodiments, the concentration of the tonicity adjusting agent is about 100 mM to about 500 mM. In some embodiments, the concentration of the tonicity adjusting agent is about 100 mM to about 200 mM, about 100 mM to about 220 mM, about 100 mM to about 240 mM, about 100 mM to about 260 mM, about 100 mM to about 280 mM, about 100 mM to about 300 mM, about 100 mM to about 350 mM, about 100 mM to about 400 mM, about 100 mM to about 450 mM, about 100 mM to about 500 mM, about 200 mM to about 220 mM, about 200 mM to about 240 mM, about 200 mM to about 260 mM, about 200 mM to about 280 mM, about 200 mM to about 300 mM, about 200 mM to about 350 mM, about 200 mM to about 400 mM, about 200 mM to about 450 mM, about 200 mM to about 500 mM, about 220 mM to about 240 mM, about 220 mM to about 260 mM, about 220 mM to about 280 mM, about 220 mM to about 300 mM, about 220 mM to about 350 mM, about 220 mM to about 400 mM, about 220 mM to about 450 mM, about 220 mM to about 500 mM, about 240 mM to about 260 mM, about 240 mM to about 280 mM, about 240 mM to about 300 mM, about 240 mM to about 350 mM, about 240 mM to about 400 mM, about 240 mM to about 450 mM, about 240 mM to about 500 mM, about 260 mM to about 280 mM, about 260 mM to about 300 mM, about 260 mM to about 350 mM, about 260 mM to about 400 mM, about 260 mM to about 450 mM, about 260 mM to about 500 mM, about 280 mM to about 300 mM, about 280 mM to about 350 mM, about 280 mM to about 400 mM, about 280 mM to about 450 mM, about 280 mM to about 500 mM, about 300 mM to about 350 mM, about 300 mM to about 400 mM, about 300 mM to about 450 mM, about 300 mM to about 500 mM, about 350 mM to about 400 mM, about 350 mM to about 450 mM, about 350 mM to about 500 mM, about 400 mM to about 450 mM, about 400 mM to about 500 mM, or about 450 mM to about 500 mM. In some embodiments, the concentration of the tonicity adjusting agent is about 100 mM, about 200 mM, about 220 mM, about 240 mM, about 260 mM, about 280 mM, about 300 mM, about 350 mM, about 400 mM, about 450 mM, or about 500 mM. In some embodiments, the concentration of the tonicity adjusting agent is at least about 100 mM, about 200 mM, about 220 mM, about 240 mM, about 260 mM, about 280 mM, about 300 mM, about 350 mM, about 400 mM, or about 450 mM. In some embodiments, the concentration of the tonicity adjusting agent is at most about 200 mM, about 220 mM, about 240 mM, about 260 mM, about 280 mM, about 300 mM, about 350 mM, about 400 mM, about 450 mM, or about 500 mM. In some embodiments, the tonicity adjusting agent is trehalose.

A pharmaceutical composition of the disclosure can comprise polysorbate. In some embodiments, polysorbate acts as a stabilizing agent. In some embodiments, polysorbate is present in a pharmaceutical composition disclosed herein at a concentration of about 50 ppm to about 500 ppm. In some embodiments, polysorbate is present in a pharmaceutical composition disclosed herein at a concentration of about 50 ppm to about 100 ppm, about 50 ppm to about 150 ppm, about 50 ppm to about 200 ppm, about 50 ppm to about 250 ppm, about 50 ppm to about 300 ppm, about 50 ppm to about 350 ppm, about 50 ppm to about 400 ppm, about 50 ppm to about 450 ppm, about 50 ppm to about 500 ppm, about 100 ppm to about 150 ppm, about 100 ppm to about 200 ppm, about 100 ppm to about 250 ppm, about 100 ppm to about 300 ppm, about 100 ppm to about 350 ppm, about 100 ppm to about 400 ppm, about 100 ppm to about 450 ppm, about 100 ppm to about 500 ppm, about 150 ppm to about 200 ppm, about 150 ppm to about 250 ppm, about 150 ppm to about 300 ppm, about 150 ppm to about 350 ppm, about 150 ppm to about 400 ppm, about 150 ppm to about 450 ppm, about 150 ppm to about 500 ppm, about 200 ppm to about 250 ppm, about 200 ppm to about 300 ppm, about 200 ppm to about 350 ppm, about 200 ppm to about 400 ppm, about 200 ppm to about 450 ppm, about 200 ppm to about 500 ppm, about 250 ppm to about 300 ppm, about 250 ppm to about 350 ppm, about 250 ppm to about 400 ppm, about 250 ppm to about 450 ppm, about 250 ppm to about 500 ppm, about 300 ppm to about 350 ppm, about 300 ppm to about 400 ppm, about 300 ppm to about 450 ppm, about 300 ppm to about 500 ppm, about 350 ppm to about 400 ppm, about 350 ppm to about 450 ppm, about 350 ppm to about 500 ppm, about 400 ppm to about 450 ppm, about 400 ppm to about 500 ppm, or about 450 ppm to about 500 ppm. In some embodiments, polysorbate is present in a pharmaceutical composition disclosed herein at a concentration of about 50 ppm, about 100 ppm, about 150 ppm, about 200 ppm, about 250 ppm, about 300 ppm, about 350 ppm, about 400 ppm, about 450 ppm, or about 500 ppm. In some embodiments, polysorbate is present in a pharmaceutical composition disclosed herein at a concentration of at least about 50 ppm, about 100 ppm, about 150 ppm, about 200 ppm, about 250 ppm, about 300 ppm, about 350 ppm, about 400 ppm, or about 450 ppm. In some embodiments, polysorbate is present in a pharmaceutical composition disclosed herein at a concentration of at most about 100 ppm, about 150 ppm, about 200 ppm, about 250 ppm, about 300 ppm, about 350 ppm, about 400 ppm, about 450 ppm, or about 500 ppm. Non-limiting examples of a polysorbate present in a pharmaceutical composition disclosed herein include polysorbate 20, polysorbate 21, polysorbate 40, polysorbate 60, polysorbate 61, polysorbate 65, polysorbate 80, polysorbate 81, polysorbate 85 or polysorbate 120.

Mode of Administration

An effective amount of a peptidomimetic macrocycles of the disclosure can be administered in either single or multiple doses by any of the accepted modes of administration. In some embodiments, the peptidomimetic macrocycles of the disclosure are administered parenterally, for example, by subcutaneous, intramuscular, intrathecal, intravenous or epidural injection. For example, the peptidomimetic macrocycle is administered intravenously, intra-arterially, subcutaneously or by infusion. In some examples, the peptidomimetic macrocycle is administered intravenously. In some examples, the peptidomimetic macrocycle is administered intra-arterially.

Regardless of the route of administration selected, the peptidomimetic macrocycles of the present disclosure, and/or the pharmaceutical compositions of the present disclosure, are formulated into pharmaceutically-acceptable dosage forms. The peptidomimetic macrocycles according to the disclosure can be formulated for administration in any convenient way for use in human or veterinary medicine, by analogy with other pharmaceuticals.

In one aspect, the disclosure provides pharmaceutical formulation comprising a therapeutically-effective amount of one or more of the peptidomimetic macrocycles described above, formulated together with one or more pharmaceutically-acceptable carriers (additives) and/or diluents. In one embodiment, one or more of the peptidomimetic macrocycles described herein are formulated for parenteral administration for parenteral administration, one or more peptidomimetic macrocycles disclosed herein can be formulated as aqueous or non-aqueous solutions, dispersions, suspensions or emulsions or sterile powders which can be reconstituted into sterile injectable solutions or dispersions just prior to use. Such formulations can comprise sugars, alcohols, antioxidants, buffers, bacteriostats, solutes which render the formulation isotonic with the blood of the intended recipient or suspending or thickening agents. These compositions can also contain adjuvants such as preservatives, wetting agents, emulsifying agents and dispersing agents. Prevention of the action of microorganisms upon the subject compounds can be ensured by the inclusion of various antibacterial and antifungal agents, for example, paraben, chlorobutanol, phenol sorbic acid, and the like. It can also be desirable to include isotonic agents, such as sugars, sodium chloride, and the like into the compositions. In addition, prolonged absorption of the injectable pharmaceutical form can be brought about by the inclusion of agents which delay absorption such as aluminum monostearate and gelatin. If desired the formulation can be diluted prior to use with, for example, an isotonic saline solution or a dextrose solution. In some examples, the peptidomimetic macrocycle is formulated as an aqueous solution and is administered intravenously.

Amount and Frequency of Administration

Dosing can be determined using various techniques. The selected dosage level can depend upon a variety of factors including the activity of the particular peptidomimetic macrocycle employed, the route of administration, the time of administration, the rate of excretion or metabolism of the particular peptidomimetic macrocycle being employed, the duration of the treatment, other drugs, compounds and/or materials used in combination with the particular peptidomimetic macrocycle employed, the age, sex, weight, condition, general health and prior medical history of the patient being treated, and like factors well known in the medical arts. The dosage values can also vary with the severity of the condition to be alleviated. For any particular subject, specific dosage regimens can be adjusted over time according to the individual need and the professional judgment of the person administering or supervising the administration of the compositions.

A physician or veterinarian can prescribe the effective amount of the pharmaceutical composition required. For example, the physician or veterinarian could start doses of the compounds of the disclosure employed in the pharmaceutical composition at levels lower than that required in order to achieve the desired therapeutic effect and gradually increase the dosage until the desired effect is achieved.

In some embodiments, a suitable daily dose of a peptidomimetic macrocycle of the disclosure can be that amount of the peptidomimetic macrocycle which is the lowest dose effective to produce a therapeutic effect. Such an effective dose generally depends upon the factors described above. The precise time of administration and amount of any particular peptidomimetic macrocycle that yields the most effective treatment in a given patient depends upon the activity, pharmacokinetics, and bioavailability of a particular peptidomimetic macrocycle, physiological condition of the patient (including age, sex, disease type and stage, general physical condition, responsiveness to a given dosage and type of medication), route of administration, and the like.

Dosage can be based on the amount of the peptidomimetic macrocycle per kg body weight of the patient. Alternatively, the dosage of the subject disclosure can be determined by reference to the plasma concentrations of the peptidomimetic macrocycle. For example, the maximum plasma concentration ($C_{max}$) and the area under the plasma concentration-time curve from time 0 to infinity (AUC) can be used.

The amount of the peptidomimetic macrocycle that is administered to a subject can be from about 1 µg/kg, 25 µg/kg, 50 mg/kg, 75 mg/kg, 100 mg/kg, 125 µg/kg, 150 µg/kg, 175 µg/kg, 200 mg/kg, 225 mg/kg, 250 µg/kg, 275 µg/kg, 300 µg/kg, 325 µg/kg, 350 mg/kg, 375 µg/kg, 400 µg/kg, 425 µg/kg, 450 µg/kg, 475 mg/kg, 500 mg/kg, 525 µg/kg, 550 µg/kg, 575 µg/kg, 600 µg/kg, 625 mg/kg, 650 mg/kg, 675 µg/kg, 700 µg/kg, 725 µg/kg, 750 mg/kg, 775 mg/kg, 800 µg/kg, 825 µg/kg, 850 µg/kg, 875 µg/kg, 900 mg/kg, 925 mg/kg, 950 µg/kg, 975 µg/kg, 1 mg/kg, 2.5 mg/kg, 5 mg/kg, 10 mg/kg, 15 mg/kg, 20 mg/kg, 25 mg/kg, 30 mg/kg, 35 mg/kg, 40 mg/kg, 45 mg/kg, 50 mg/kg, 60 mg/kg, 70 mg/kg, 80 mg/kg, 90 mg/kg, or 100 mg/kg per body weight of the subject.

The amount of the peptidomimetic macrocycle that is administered to a subject can be from about 0.01 mg/kg to about 100 mg/kg body weight of the subject. In some embodiments, the amount of the peptidomimetic macrocycle administered is about 0.01-10 mg/kg, about 0.01-20 mg/kg, about 0.01-50 mg/kg, about 0.1-10 mg/kg, about 0.1-20 mg/kg, about 0.1-50 mg/kg, about 0.1-100 mg/kg, about 0.5-10 mg/kg, about 0.5-20 mg/kg, about 0.5-50 mg/kg, about 0.5-100 mg/kg, about 1-10 mg/kg, about 1-20 mg/kg, about 1-50 mg/kg, or about 1-100 mg/kg body weight of the human subject. In some embodiments, the amount of the peptidomimetic macrocycle administered is about 0.1 mg/kg, 0.2 mg/kg, 0.3 mg/kg, 0.4 mg/kg, 0.5 mg/kg, 0.6 mg/kg, 0.7 mg/kg, 0.8 mg/kg, 0.9 mg/kg, 1 mg/kg, 2 mg/kg, 3 mg/kg, 4 mg/kg, 5 mg/kg, 6 mg/kg, 7 mg/kg, 8 mg/kg, 9 mg/kg, 10 mg/kg, 11 mg/kg, 12 mg/kg, 13 mg/kg, 14 mg/kg, 15 mg/kg, 16 mg/kg, 17 mg/kg, 18 mg/kg, 19 mg/kg, or 20 mg/kg body weight of the subject. In some embodiments, the amount of the peptidomimetic macrocycle administered is about 5 mg/kg. In some embodiments, the amount of the peptidomimetic macrocycle administered is about 10 mg/kg. In some embodiments, the amount of the peptidomimetic macrocycle administered is about 15 mg/kg.

In some embodiments, the amount of the peptidomimetic macrocycle administered is about 0.16 mg, about 0.32 mg, about 0.64 mg, about 1.28 mg, about 3.56 mg, about 7.12 mg, about 14.24 mg, or about 20 mg per kilogram body weight of the subject. In some examples the amount of the peptidomimetic macrocycle administered is about 0.16 mg per kilogram body weight of the subject. In some examples the amount of the peptidomimetic macrocycle administered is about 0.32 mg per kilogram body weight of the subject. In some examples the amount of the peptidomimetic macrocycle administered is about 0.64 mg per kilogram body weight of the subject. In some examples the amount of the peptidomimetic macrocycle administered is about 1.28 mg per kilogram body weight of the subject. In some examples the amount of the peptidomimetic macrocycle administered is about 3.56 mg per kilogram body weight of the subject. In some examples the amount of the peptidomimetic macrocycle administered is about 7.12 mg per kilogram body weight of the subject. In some examples the amount of the peptidomimetic macrocycle administered is about 14.24 mg per kilogram body weight of the subject.

In some embodiments, a pharmaceutically-acceptable amount of a peptidomimetic macrocycle is administered to a subject 1, 2, 3, 4, 5, 6, 7, 8, 9, 10, 11, 12, 13, or 14 times a week. In some embodiments about 0.5-about 20 mg or about 0.5-about 10 mg of the peptidomimetic macrocycle per kilogram body weight of the human subject is administered once a week. For example about 0.5-about 1 mg, about 0.5-about 5 mg, about 0.5-about 10 mg, about 0.5-about 15 mg, about 1-about 5 mg, about 1-about 10 mg, about 1-about 15 mg, about 1-about 20 mg, about 5-about 10 mg, about 1-about 15 mg, about 5-about 20 mg, about 10-about 15 mg, about 10-about 20 mg, or about 15-about 20 mg of the peptidomimetic macrocycle per kilogram body weight of the human subject is administered once a week. In some examples about 1 mg, about 1.25 mg, about 1.5 mg, about 1.75 mg, about 2 mg, about 2.25 mg, about 2.5 mg, about 2.75 mg, about 3 mg, about 3.25 mg, about 3.5 mg, about 3.75 mg, about 4 mg, about 4.25 mg, about 4.5 mg, about 4.75 mg, about 5 mg, about 5.25 mg, about 5.5 mg, about 5.75 mg, about 6 mg, about 6.25 mg, about 6.5 mg, about 6.75 mg, about 7 mg, about 7.25 mg, about 7.5 mg, about 7.75 mg, about 8 mg, about 8.25 mg, about 8.5 mg, about 8.75 mg, about 9 mg, about 9.25 mg, about 9.5 mg, about 9.75 mg, about 10 mg, about 10.25 mg, about 10.5 mg, about 10.75 mg, about 11 mg, about 11.25 mg, about 11.5 mg, about 11.75 mg, about 12 mg, about 12.25 mg, about 12.5 mg, about 12.75 mg, about 13 mg, about 13.25 mg, about 13.5 mg, about 13.75 mg, about 14 mg, about 14.25 mg, about 14.5 mg, about 14.75 mg, about 15 mg, about 15.25 mg, about 15.5 mg, about 15.75 mg, about 16 mg, about 16.5 mg, about 17 mg, about 17.5 mg, about 18 mg, about 18.5 mg, about 19 mg, about 19.5 mg, or about 20 mg of the peptidomimetic macrocycle per kilogram body weight of the human subject is administered once a week. In some examples, the amount of the peptidomimetic macrocycle administered is about 1.25 mg, about 2.5 mg, about 5 mg, about 10 mg, or about 20 mg per kilogram body weight of the human subject and the peptidomimetic macrocycle is administered once a week. In some examples, the amount of the peptidomimetic macrocycle administered is about 1.25 mg, about 2.5 mg, about 5 mg or about 10 mg per kilogram body weight of the human subject and the peptidomimetic macrocycle is administered once a week.

In some embodiments about 0.5-about 20 mg or about 0.5-about 10 mg of the peptidomimetic macrocycle per kilogram body weight of the human subject is administered two times a week. For example about 0.5-about 1 mg, about 0.5-about 5 mg, about 0.5-about 10 mg, about 0.5-about 15 mg, about 1-about 5 mg, about 1-about 10 mg, about 1-about 15 mg, about 1-about 20 mg, about 5-about 10 mg, about 1-about 15 mg, about 5-about 20 mg, about 10-about 15 mg, about 10-about 20 mg, or about 15-about 20 mg of the peptidomimetic macrocycle per kilogram body weight of the human subject is administered about twice a week. In some examples about 1 mg, about 1.25 mg, about 1.5 mg, about 1.75 mg, about 2 mg, about 2.25 mg, about 2.5 mg, about 2.75 mg, about 3 mg, about 3.25 mg, about 3.5 mg, about 3.75 mg, about 4 mg, about 4.25 mg, about 4.5 mg, about 4.75 mg, about 5 mg, about 5.25 mg, about 5.5 mg, about 5.75 mg, about 6 mg, about 6.25 mg, about 6.5 mg, about 6.75 mg, about 7 mg, about 7.25 mg, about 7.5 mg, about 7.75 mg, about 8 mg, about 8.25 mg, about 8.5 mg, about 8.75 mg, about 9 mg, about 9.25 mg, about 9.5 mg, about 9.75 mg, about 10 mg, about 10.25 mg, about 10.5 mg, about 10.75 mg, about 11 mg, about 11.25 mg, about 11.5 mg, about 11.75 mg, about 12 mg, about 12.25 mg, about 12.5 mg, about 12.75 mg, about 13 mg, about 13.25 mg, about 13.5 mg, about 13.75 mg, about 14 mg, about 14.25 mg, about 14.5 mg, about 14.75 mg, about 15 mg, about 15.25 mg, about 15.5 mg, about 15.75 mg, about 16 mg, about 16.5 mg, about 17 mg, about 17.5 mg, about 18 mg, about 18.5 mg, about 19 mg, about 19.5 mg, or about 20 mg of the peptidomimetic macrocycle per kilogram body weight of the human subject is administered two times a week. In some examples, the amount of the peptidomimetic macrocycle administered is about 1.25 mg, about 2.5 mg, about 5 mg, about 10 mg, or about 20 mg per kilogram body weight of the human subject and the peptidomimetic macrocycle is administered two times a week. In some examples, the amount of the peptidomimetic macrocycle administered is about 1.25 mg, about 2.5 mg, about 5 mg or about 10 mg per kilogram body weight of the human subject and the peptidomimetic macrocycle is administered two times a week.

In some embodiments about 0.5-about 20 mg or about 0.5-about 10 mg of the peptidomimetic macrocycle per kilogram body weight of the human subject is administered 3, 4, 5, 6, or 7 times a week. For example, about 0.5-about 1 mg, about 0.5-about 5 mg, about 0.5-about 10 mg, about 0.5-about 15 mg, about 1-about 5 mg, about 1-about 10 mg, about 1-about 15 mg, about 1-about 20 mg, about 5-about 10 mg, about 1-about 15 mg, about 5-about 20 mg, about 10-about 15 mg, about 10-about 20 mg, or about 15-about 20 mg of the peptidomimetic macrocycle per kilogram body weight of the human subject is administered 3, 4, 5, 6, or 7 times a week. In some examples about 1 mg, about 1.25 mg, about 1.5 mg, about 1.75 mg, about 2 mg, about 2.25 mg, about 2.5 mg, about 2.75 mg, about 3 mg, about 3.25 mg, about 3.5 mg, about 3.75 mg, about 4 mg, about 4.25 mg, about 4.5 mg, about 4.75 mg, about 5 mg, about 5.25 mg, about 5.5 mg, about 5.75 mg, about 6 mg, about 6.25 mg, about 6.5 mg, about 6.75 mg, about 7 mg, about 7.25 mg, about 7.5 mg, about 7.75 mg, about 8 mg, about 8.25 mg, about 8.5 mg, about 8.75 mg, about 9 mg, about 9.25 mg, about 9.5 mg, about 9.75 mg, about 10 mg, about 10.25 mg, about 10.5 mg, about 10.75 mg, about 11 mg, about 11.25 mg, about 11.5 mg, about 11.75 mg, about 12 mg, about 12.25 mg, about 12.5 mg, about 12.75 mg, about 13 mg, about 13.25 mg, about 13.5 mg, about 13.75 mg, about 14 mg, about 14.25 mg, about 14.5 mg, about 14.75 mg, about 15 mg, about 15.25 mg, about 15.5 mg, about 15.75 mg, about 16 mg, about 16.5 mg, about 17 mg, about 17.5 mg, about 18 mg, about 18.5 mg, about 19 mg, about 19.5 mg, or about 20 mg of the peptidomimetic macrocycle per kilogram body weight of the human subject is administered 3, 4, 5, 6, or 7 times a week. In some examples, the amount of the peptidomimetic macrocycle administered is about 1.25 mg, about 2.5 mg, about 5 mg, about 10 mg, or about 20 mg per kilogram body weight of the human subject and the peptidomimetic macrocycle is administered 3, 4, 5, 6, or 7 times a week. In some examples, the amount of the peptidomimetic macrocycle administered is about 1.25 mg, about 2.5 mg, about 5 mg, or about 10 mg per kilogram body weight of the human subject and the peptidomimetic macrocycle is administered 3, 4, 5, 6, or 7 times a week.

In some embodiments, a pharmaceutically-acceptable amount of a peptidomimetic macrocycle is administered to a subject once every 1, 2, 3, 4, 5, 6, 7, or 8 weeks. In some embodiments, about 0.5-about 20 mg or about 0.5-about 10 mg of the peptidomimetic macrocycle per kilogram body weight of the human subject is administered once every 2, 3, or 4 weeks. For example, about 0.5-about 1 mg, about 0.5-about 5 mg, about 0.5-about 10 mg, about 0.5-about 15 mg, about 1-about 5 mg, about 1-about 10 mg, about 1-about 15 mg, about 1-about 20 mg, about 5-about 10 mg, about 1-about 15 mg, about 5-about 20 mg, about 10-about 15 mg, about 10-about 20 mg, or about 15-about 20 mg of the peptidomimetic macrocycle per kilogram body weight of the human subject is administrated 3, 4, 5, 6, or 7 once every 2 or 3 week. In some examples about 1 mg, about 1.25 mg, about 1.5 mg, about 1.75 mg, about 2 mg, about 2.25 mg, about 2.5 mg, about 2.75 mg, about 3 mg, about 3.25 mg, about 3.5 mg, about 3.75 mg, about 4 mg, about 4.25 mg, about 4.5 mg, about 4.75 mg, about 5 mg, about 5.25 mg, about 5.5 mg, about 5.75 mg, about 6 mg, about 6.25 mg, about 6.5 mg, about 6.75 mg, about 7 mg, about 7.25 mg, about 7.5 mg, about 7.75 mg, about 8 mg, about 8.25 mg, about 8.5 mg, about 8.75 mg, about 9 mg, about 9.25 mg, about 9.5 mg, about 9.75 mg, about 10 mg, about 10.25 mg, about 10.5 mg, about 10.75 mg, about 11 mg, about 11.25 mg, about 11.5 mg, about 11.75 mg, about 12 mg, about 12.25 mg, about 12.5 mg, about 12.75 mg, about 13 mg, about 13.25 mg, about 13.5 mg, about 13.75 mg, about 14 mg, about 14.25 mg, about 14.5 mg, about 14.75 mg, about 15 mg, about 15.25 mg, about 15.5 mg, about 15.75 mg, about 16 mg, about 16.5 mg, about 17 mg, about 17.5 mg, about 18 mg, about 18.5 mg, about 19 mg, about 19.5 mg, or about 20 mg of the peptidomimetic macrocycle per kilogram body weight of the human subject is administered once every 2 or 3 weeks. In some examples, the amount of the peptidomimetic macrocycle administered is about 1.25 mg, about 2.5 mg, about 5 mg, about 10 mg, or about 20 mg per kilogram body weight of the human subject and the peptidomimetic macrocycle is administered once every 2 weeks. In some examples, the amount of the peptidomimetic macrocycle administered is about 1.25 mg, about 2.5 mg, about 5 mg or about 10 mg per kilogram body weight of the human subject and the peptidomimetic macrocycle is administered once every 2 weeks. In some examples, the amount of the peptidomimetic macrocycle administered is about 1.25 mg, about 2.5 mg, about 5 mg, about 10 mg, or about 20 mg per kilogram body weight of the human subject and the peptidomimetic macrocycle is administered once every 3 weeks. In some examples, the amount of the peptidomimetic macrocycle administered is about 1.25 mg, about 2.5 mg, about 5 mg, or about 10 mg per kilogram body weight of the human subject and the peptidomimetic macrocycle is administered once every 3 weeks.

In some embodiments, a pharmaceutically-acceptable amount of a peptidomimetic macrocycle is administered to a subject gradually over a period of time. In some embodiments, an amount of a peptidomimetic macrocycle can be administered to a subject gradually over a period of from about 0.1 h to about 24 h. In some embodiments, an amount of a peptidomimetic macrocycle can be administered to a subject over a period of about 0.1 h, about 0.2 h, about 0.3 h, about 0.4 h, about 0.5 h, about 0.6 h, about 0.7 h, about 0.8 h, about 0.9 h, about 1 h, about 1.5 h, about 2 h, about 2.5 h, about 3 h, about 3.5 h, about 4 h, about 4.5 h, about 5 h, about 5.5 h, about 6 h, about 6.5 h, about 7 h, about 7.5 h, about 8 h, about 8.5 h, about 9 h, about 9.5 h, about 10 h, about 10.5 h, about 11 h, about 11.5 h, about 12 h, about 12.5 h, about 13 h, about 13.5 h, about 14 h, about 14.5 h, about 15 h, about 15.5 h, about 16 h, about 16.5 h, about 17 h, about 17.5 h, about 18 h, about 18.5 h, about 19 h, about 19.5 h, about 20 h, about 20.5 h, about 21 h, about 21.5 h, about 22 h, about 22.5 h, about 23 h, about 23.5 h, or about 24 h. In some embodiments, a pharmaceutically-acceptable amount of a peptidomimetic macrocycle is administered gradually over a period of about 0.5 h. In some embodiments, a pharmaceutically-acceptable amount of a peptidomimetic macrocycle is administered gradually over a period of about 1 h. In some embodiments, a pharmaceutically-acceptable amount of a peptidomimetic macrocycle is administered gradually over a period of about 1.5 h.

Administration of the peptidomimetic macrocycles can continue for as long as clinically necessary. In some embodiments, a peptidomimetic macrocycle of the disclosure can be administered for more than 1 day, more than 1 week, more than 1 month, more than 2 months, more than 3 months, more than 4 months, more than 5 months, more than 6 months, more than 7 months, more than 8 months, more than 9 months, more than 10 months, more than 11 months, more than 12 months, more than 13 months, more than 14 months, more than 15 months, more than 16 months, more than 17 months, more than 18 months, more than 19 months, more than 20 months, more than 21 months, more than 22 months, more than 23 months, or more than 24 months. In some embodiments, one or more peptidomimetic macrocycle of the disclosure is administered for less than 1 week, less than 1 month, less than 2 months, less than 3 months, less than 4 months, less than 5 months, less than 6 months, less than 7 months, less than 8 months, less than 9 months, less than 10 months, less than 11 months, less than 12 months, less than 13 months, less than 14 months, less than 15 months, less than 16 months, less than 17 months, less than 18 months, less than 19 months, less than 20 months, less than 21 months, less than 22 months, less than 23 months, or less than 24 months.

In some embodiments, a peptidomimetic macrocycle can be administered to a subject 1, 2, 3, 4, 5, 6, 7, 8, 9, 10, 11, 12, 13, 14, 15, 16, 17, 18, 19, or 20 times over a treatment cycle. In some embodiments a peptidomimetic macrocycle can be administered to a subject 2, 4, 6, or 8 times over a treatment cycle. In some embodiments, a peptidomimetic macrocycle can be administered to a subject 4 times over a treatment cycle. In some embodiments, a treatment cycle is 7 days, 14 days, 21 days, or 28 days long. In some embodiments, a treatment cycle is 21 days long. In some embodiments, a treatment cycle is 28 days long.

In some embodiments, a peptidomimetic macrocycle is administered on day 1, 8, 15 and 28 of a 28 day cycle. In some embodiments, the peptidomimetic macrocycle is administered on day 1, 8, 15 and 28 of a 28 day cycle and administration is continued for two cycles. In some embodiments, the peptidomimetic macrocycle is administered on day 1, 8, 15 and 28 of a 28 day cycle and administration is continued for three cycles. In some embodiments, the peptidomimetic macrocycle is administered on day 1, 8, 15 and 28 of a 28 day cycle and administration is continued for 4, 5, 6, 7, 8, 9, 10, or more than 10 cycles.

In some embodiments, the peptidomimetic macrocycle is administered on day 1, 8, 11 and 21 of a 21-day cycle. In some embodiments, the peptidomimetic macrocycle is administered on day 1, 8, 11 and 21 of a 21-day cycle and administration is continued for two cycles. In some embodiments, the peptidomimetic macrocycle is administered on day 1, 8, 11 and 21 of a 21-day cycle and administration is continued for three cycles. In some embodiments, the peptidomimetic macrocycle is administered on day 1, 8, 11 and 21 of a 21-day cycle and administration is continued for 4, 5, 6, 7, 8, 9, 10, or more than 10 cycles.

In some embodiments, one or more peptidomimetic macrocycle of the disclosure is administered chronically on an ongoing basis. In some embodiments administration of one or more peptidomimetic macrocycle of the disclosure is continued until documentation of disease progression, unacceptable toxicity, or patient or physician decision to discontinue administration.

In some embodiments, the compounds of the invention can be used to treat one condition. In some embodiments, the compounds of the invention can be used to treat two conditions. In some embodiments, the compounds of the invention can be used to treat three conditions. In some embodiments, the compounds of the invention can be used to treat four conditions. In some embodiments, the compounds of the invention can be used to treat five conditions.

Methods of Use

In one aspect, provided herein are novel peptidomimetic macrocycles that are useful in competitive binding assays to identify agents which bind to the natural ligand(s) of the proteins or peptides upon which the peptidomimetic macrocycles are modeled. For example, in the p53/MDMX system, labeled peptidomimetic macrocycles based on p53 can be used in a MDMX binding assay along with small molecules that competitively bind to MDMX. Competitive binding studies allow for rapid in vitro evaluation and determination of drug candidates specific for the p53/MDMX system. Such binding studies can be performed with any of the peptidomimetic macrocycles disclosed herein and their binding partners. Further provided are methods for the generation of antibodies against the peptidomimetic macrocycles. In some embodiments, these antibodies specifically bind both the peptidomimetic macrocycle and the precursor peptides, such as p53, to which the peptidomimetic macrocycles are related. Such antibodies, for example, disrupt the native protein-protein interaction, for example, binding between p53 and MDMX.

In other aspects, provided herein are both prophylactic and therapeutic methods of treating a subject at risk of (or susceptible to) a disorder or having a disorder associated with aberrant (e.g., insufficient or excessive) expression or activity of the molecules including p53, MDM2 or MDMX.

In another embodiment, a disorder is caused, at least in part, by an abnormal level of p53 or MDM2 or MDMX, (e.g., over or under expression), or by the presence of p53 or MDM2 or MDMX exhibiting abnormal activity. As such, the reduction in the level and/or activity of p53 or MDM2 or MDMX, or the enhancement of the level and/or activity of p53 or MDM2 or MDMX, by peptidomimetic macrocycles derived from p53, is used, for example, to ameliorate or reduce the adverse symptoms of the disorder.

In another aspect, provided herein are methods for treating or preventing a disease including hyperproliferative disease and inflammatory disorder by interfering with the interaction or binding between binding partners, for example, between p53 and MDM2 or p53 and MDMX. These methods comprise administering an effective amount of a compound to a warm blooded animal, including a human. In some embodiments, the administration of one or more compounds disclosed herein induces cell growth arrest or apoptosis.

In some embodiments, the peptidomimetic macrocycles can be used to treat, prevent, and/or diagnose cancers and neoplastic conditions. As used herein, the terms "cancer", "hyperproliferative" and "neoplastic" refer to cells having the capacity for autonomous growth, i.e., an abnormal state or condition characterized by rapidly proliferating cell growth. Hyperproliferative and neoplastic disease states can be categorized as pathologic, i.e., characterizing or constituting a disease state, or can be categorized as non-pathologic, i.e., a deviation from normal but not associated with a disease state. The term is meant to include all types of cancerous growths or oncogenic processes, metastatic tissues or malignantly transformed cells, tissues, or organs, irrespective of histopathologic type or stage of invasiveness. A metastatic tumor can arise from a multitude of primary tumor types, including but not limited to those of breast, lung, liver, colon and ovarian origin. "Pathologic hyperproliferative" cells occur in disease states characterized by malignant tumor growth. Examples of non-pathologic hyperproliferative cells include proliferation of cells associated with wound repair. Examples of cellular proliferative and/or differentiation disorders include cancer, e.g., carcinoma, sarcoma, or metastatic disorders. In some embodiments, the peptidomimetic macrocycles are novel therapeutic agents for controlling breast cancer, ovarian cancer, colon cancer, lung cancer, metastasis of such cancers and the like.

Examples of cancers or neoplastic conditions include, but are not limited to, a fibrosarcoma, myosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, gastric cancer, esophageal cancer, rectal cancer, pancreatic cancer, ovarian cancer, prostate cancer, uterine cancer, cancer of the head and neck, skin cancer, brain cancer, squamous cell carcinoma, sebaceous gland carcinoma, papillary carcinoma, papillary adenocarcinoma, cystadenocarcinoma, medullary carcinoma, bronchogenic carcinoma, renal cell carcinoma, hepatoma, bile duct carcinoma, choriocarcinoma, seminoma, embryonal carcinoma, Wilm's tumor, cervical cancer, testicular cancer, small cell lung carcinoma, non-small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, meningioma, melanoma, neuroblastoma, retinoblastoma, leukemia, lymphoma, or Kaposi sarcoma.

In some embodiments, the cancer is head and neck cancer, melanoma, lung cancer, breast cancer, or glioma.

Examples of proliferative disorders include hematopoietic neoplastic disorders. As used herein, the term "hematopoietic neoplastic disorders" includes diseases involving hyperplastic/neoplastic cells of hematopoietic origin, e.g., arising from myeloid, lymphoid or erythroid lineages, or precursor cells thereof. The diseases can arise from poorly differentiated acute leukemias, e.g., erythroblastic leukemia and acute megakaryoblastic leukemia. Additional exemplary myeloid disorders include, but are not limited to, acute promyeloid leukemia (APML), acute myelogenous leukemia (AML) and chronic myelogenous leukemia (CML); lymphoid malignancies include, but are not limited to acute lymphoblastic leukemia (ALL) which includes B-lineage ALL and T-lineage ALL, chronic lymphocytic leukemia (CLL), prolymphocytic leukemia (PLL), hairy cell leukemia (HLL) and Waldenstrom's macroglobulinemia (WM). Additional forms of malignant lymphomas include, but are not limited to non-Hodgkin lymphoma and variants thereof, peripheral T cell lymphomas, adult T cell leukemia/lymphoma (ATL), cutaneous T-cell lymphoma (CTCL), periphieral T-cell lymphoma (PTCL), large granular lymphocytic leukemia (LGF), Hodgkin's disease and Reed-Stemberg disease.

Examples of cellular proliferative and/or differentiation disorders of the breast include, but are not limited to, proliferative breast disease including, e.g., epithelial hyperplasia, sclerosing adenosis, and small duct papillomas; tumors, e.g., stromal tumors such as fibroadenoma, phyllodes tumor, and sarcomas, and epithelial tumors such as large duct papilloma; carcinoma of the breast including in situ (noninvasive) carcinoma that includes ductal carcinoma in situ (including Paget's disease) and lobular carcinoma in situ, and invasive (infiltrating) carcinoma including, but not limited to, invasive ductal carcinoma, invasive lobular carcinoma, medullary carcinoma, colloid (mucinous) carcinoma, tubular carcinoma, and invasive papillary carcinoma, and miscellaneous malignant neoplasms. Disorders in the male breast include, but are not limited to, gynecomastia and carcinoma.

Examples of cellular proliferative and/or differentiative disorders of the skin include, but are not limited to proliferative skin disease such as melanomas, including mucosal melanoma, superficial spreading melanoma, nodular melanoma, lentigo (e.g. lentigo maligna, lentigo maligna melanoma, or acral lentiginous melanoma), amelanotic melanoma, desmoplastic melanoma, melanoma with features of a Spitz nevus, melanoma with small nevus-like cells, polypoid melanoma, and soft-tissue melanoma; basal cell carcinomas including micronodular basal cell carcinoma, superficial basal cell carcinoma, nodular basal cell carcinoma (rodent ulcer), cystic basal cell carcinoma, cicatricial basal cell carcinoma, pigmented basal cell carcinoma, aberrant basal cell carcinoma, infiltrative basal cell carcinoma, nevoid basal cell carcinoma syndrome, polypoid basal cell carcinoma, pore-like basal cell carcinoma, and fibroepithelioma of Pinkus; squamus cell carcinomas including acanthoma (large cell acanthoma), adenoid squamous cell carcinoma, basaloid squamous cell carcinoma, clear cell squamous cell carcinoma, signet-ring cell squamous cell carcinoma, spindle cell squamous cell carcinoma, Marjolin's ulcer, erythroplasia of Queyrat, and Bowen's disease; or other skin or subcutaneous tumors.

Examples of cellular proliferative and/or differentiation disorders of the lung include, but are not limited to, bronchogenic carcinoma, including paraneoplastic syndromes, bronchioloalveolar carcinoma, neuroendocrine tumors, such as bronchial carcinoid, miscellaneous tumors, and metastatic tumors; pathologies of the pleura, including inflammatory pleural effusions, noninflammatory pleural effusions, pneumothorax, and pleural tumors, including solitary fibrous tumors (pleural fibroma) and malignant mesothelioma.

Examples of cellular proliferative and/or differentiative disorders of the colon include, but are not limited to, non-neoplastic polyps, adenomas, familial syndromes, colorectal carcinogenesis, colorectal carcinoma, and carcinoid tumors.

Examples of cellular proliferative and/or differentiative disorders of the liver include, but are not limited to, nodular hyperplasias, adenomas, and malignant tumors, including primary carcinoma of the liver and metastatic tumors.

Examples of cellular proliferative and/or differentiative disorders of the ovary include, but are not limited to, ovarian tumors such as, tumors of coelomic epithelium, serous tumors, mucinous tumors, endometrioid tumors, clear cell adenocarcinoma, cystadenofibroma, Brenner tumor, surface epithelial tumors; germ cell tumors such as mature (benign) teratomas, monodermal teratomas, immature malignant teratomas, dysgerminoma, endodermal sinus tumor, choriocarcinoma; sex cord-stomal tumors such as, granulosa-theca cell tumors, thecomafibromas, androblastomas, hill cell tumors, and gonadoblastoma; and metastatic tumors such as Krukenberg tumors.

Combination Treatment

Combination therapy with a peptidomimetic macrocycle of the disclosure and at least one additional therapeutic agent, for example, any additional therapeutic agent described herein, can be used to treat a condition. In some embodiments, the combination therapy can produce a significantly better therapeutic result than the additive effects achieved by each individual constituent when administered alone at a therapeutic dose. In some embodiments, the dosage of the peptidomimetic macrocycle or additional therapeutic agent, for example, any additional therapeutic agent described herein, in combination therapy can be reduced as compared to monotherapy with each agent, while still achieving an overall therapeutic effect. In some embodiments, a peptidomimetic macrocycle and an additional therapeutic agent, for example, any additional therapeutic agent described herein, can exhibit a synergistic effect. In some embodiments, the synergistic effect of a peptidomimetic macrocycle and additional therapeutic agent, for example, any additional therapeutic agent described herein, can be used to reduce the total amount drugs administered to a subject, which decrease side effects experienced by the subject.

The peptidomimetic macrocycles of the disclosure can be used in combination with at least one additional pharmaceutically-active agent, for example, any additional therapeutic agent described herein. In some embodiments, the at least one additional pharmaceutically-active agent, for example, any additional therapeutic agent described herein, can modulate the same or a different target as the peptidomimetic macrocycles of the disclosure. In some embodiments, the at least one additional pharmaceutically-active agent, for example, any additional therapeutic agent described herein, can modulate the same target as the peptidomimetic macrocycles of the disclosure, or other components of the same pathway, or overlapping sets of target enzymes. In some embodiments, the at least one additional pharmaceutically-active agent, for example, any additional therapeutic agent described herein, can modulate a different target from the peptidomimetic macrocycles of the disclosure.

Accordingly, in one aspect, the present disclosure provides a method for treating cancer, the method comprising administering to a subject in need thereof (a) an effective amount of a peptidomimetic macrocycle of the disclosure and (b) an effective amount of at least one additional pharmaceutically active agent, for example, any additional therapeutic agent described herein, to provide a combination therapy. In some embodiments, the combination therapy may have an enhanced therapeutic effect compared to the effect of the peptidomimetic macrocycle and the at least one additional pharmaceutically active agent each administered alone. According to certain exemplary embodiments, the combination therapy has a synergistic therapeutic effect. According to this embodiment, the combination therapy produces a significantly better therapeutic result (e.g., anti-cancer, cell growth arrest, apoptosis, induction of differentiation, cell death, etc.) than the additive effects achieved by each individual constituent when administered alone at a therapeutic dose.

Combination therapy includes but is not limited to the combination of peptidomimetic macrocycles of this disclosure with chemotherapeutic agents, therapeutic antibodies, and radiation treatment, to provide a synergistic therapeutic effect. In some embodiments, the peptidomimetic macrocycles of the disclosure are used in combination with one or more anti-cancer (antineoplastic or cytotoxic) chemotherapy drug. Suitable chemotherapeutic agents for use in the combinations of the present disclosure include, but are not limited to, alkylating agents, antibiotic agents, antimetabolic agents, hormonal agents, plant-derived agents, anti-angiogenic agents, differentiation inducing agents, cell growth arrest inducing agents, apoptosis inducing agents, cytotoxic agents, agents affecting cell bioenergetics, biologic agents, e.g., monoclonal antibodies, kinase inhibitors and inhibitors of growth factors and their receptors, gene therapy agents, cell therapy, or any combination thereof.

In some embodiments, a method of treating cancer in a subject in need thereof can comprise administering to the subject a therapeutically effective amount of a p53 agent that inhibits the interaction between p53 and MDM2 and/or p53 and MDMX, and/or modulates the activity of p53 and/or MDM2 and/or MDMX; and at least one additional pharmaceutically-active agent. In some examples, the p53 agent is selected from the group consisting of a small organic or inorganic molecule; a saccharine; an oligosaccharide; a polysaccharide; a peptide, a protein, a peptide analog, a peptide derivative; an antibody, an antibody fragment, a peptidomimetic; a peptidomimetic macrocycle of the disclosure; a nucleic acid; a nucleic acid analog, a nucleic acid derivative; an extract made from biological materials; a naturally-occurring or synthetic composition; and any combination thereof.

In some embodiments, the p53 agent is selected from the group consisting of RG7388 (RO5503781, idasanutlin), RG7112 (RO5045337), nutlin3a, nutlin3b, nutlin3, nutlin2, spirooxindole containing small molecules, 1,4-diazepines, 1,4-benzodiazepine-2,5-dione compounds, WK23, WK298, SJ172550, RO2443, RO5963, RO5353, RO2468, MK8242 (SCH900242), MI888, MI773 (SAR405838), NVPCGM097, DS3032b, AM8553, AMG232, NSC207895 (XI006), JNJ26854165 (serdemetan), RITA (NSC652287), YH239EE, or any combination thereof. In some examples, the at least one additional pharmaceutically-active agent is selected from the group consisting of palbociclib (PD0332991); abemaciclib (LY2835219); ribociclib (LEE 011); voruciclib (P1446A-05); fascaplysin; arcyriaflavin; 2-bromo-12,13-dihydro-5H-indolo[2,3-a]pyrrolo[3,4-c]carbazole-5,7(6H)-dione; 3-amino thioacridone (3-ATA), trans-4-((6-(ethylamino)-2-((1-(phenylmethyl)-1H-indol-5-yl)amino)-4-pyrimidinyl)amino)-cyclohexano (CINK4); 1,4-dimethoxyacridine-9(10H)-thione (NSC 625987); 2-methyl-5-(p-tolylamino)benzo[d]thiazole-4,7-dione (ryuvidine); and flavopiridol (alvocidib); and any combination thereof.

a. Combination Treatment with Estrogen Receptor Antagonists

In some embodiments, the peptidomimetic macrocycles of the disclosure are used in combination with an estrogen receptor antagonist. In some embodiments, the peptidomimetic macrocycles of the disclosure are used in combination with toremifene (Fareston®), fulvestrant (Faslodex®), or tamoxifen citrate (Soltamox®).

Fulvestrant is a selective estrogen receptor degrader (SERD) and is indicated for the treatment of hormone receptor positive metastatic breast cancer in postmenopausal women with disease progression following anti-estrogen therapy. Fulvestrant is a complete estrogen receptor antagonist with little to no agonist effects and accelerates the proteasomal degradation of the estrogen receptor. Fulvestrant has poor oral bioavailability and is administered via intramuscular injection. Fulvestrant-induced expression of ErbB3 and ErbB4 receptors sensitizes oestrogen receptor-positive breast cancer cells to heregulin beta1. In some embodiments, the peptidomimetic macrocycles of the disclosure are used in combination with fulvestrant.

b. Combination Treatment with Aromatase Inhibitors

In some embodiments, the peptidomimetic macrocycles of the disclosure are used in combination with an aromatase inhibitor. Aromatase inhibitors are used in the treatment of breast cancer in post-menopausal women and gynecomastia in men. Aromatase inhibitors can be used off-label to reduce estrogen conversion when using external testosterone. Aromatase inhibitors can also be used for chemoprevention in high-risk women.

In some embodiments, the peptidomimetic macrocycles of the disclosure are used in combination with a non-selective aromatase inhibitor. In some embodiments, the peptidomimetic macrocycles of the disclosure can be used in combination with a non-selective aromatase inhibitor, such as aminoglutethimide or testolactone (Teslac®). In some embodiments, the peptidomimetic macrocycles of the disclosure are used in combination with a selective aromatase inhibitor. In some embodiments, the peptidomimetic macrocycles of the disclosure are used in combination with a selective aromatase inhibitor, such as anastrozole (Arimidex®), letrozole (Femara®), exemestane (Aromasin®), vorozole (Rivizor®), formestane (Lentaron®), or fadrozole (Afema®). In some embodiments, the peptidomimetic macrocycles of the disclosure are used in combination with exemestane. In some embodiments, the peptidomimetic macrocycles of the disclosure are used in combination with an aromatase inhibitor that has unknown mechanism of action, such as 1,4,6-androstatrien-3,17-dione (ATD) or 4-androstene-3,6,17-trione.

c. Combination Treatment with mTOR Inhibitors

In some embodiments, the peptidomimetic macrocycles of the disclosure are used in combination with an mTOR inhibitor. mTOR inhibitors are drugs that inhibit the mechanistic target of rapamycin (mTOR), which is a serine/threonine-specific protein kinase that belongs to the family of phosphatidylinositol-3 kinase (PI3K)-related kinases (PIKKs). mTOR regulates cellular metabolism, growth, and proliferation by forming and signaling through the protein complexes mTORC1 and mTORC2.

In some embodiments, the peptidomimetic macrocycles of the disclosure are used in combination with an mTOR inhibitor, such as rapamycin, temsirolimus (CCI-779), everolimus (RAD001), ridaforolimus (AP-23573). In some embodiments, the peptidomimetic macrocycles of the disclosure are used in combination with everolimus (Afinitor®). Everolimus affects the mTORC1 protein complex and can lead to hyper-activation of the kinase AKT, which can lead to longer survival in some cell types. Everolimus binds to FKBP12, a protein receptor which directly interacts with mTORC1 and inhibits downstream signaling. mRNAs that codify proteins implicated in the cell cycle and in the glycolysis process are impaired or altered as a result, inhibiting tumor growth and proliferation.

In some embodiments, the peptidomimetic macrocycles of the disclosure are used in combination with a mTOR inhibitor and an aromatase inhibitor. For example, the peptidomimetic macrocycles can be used in combination with everolimus and exemestane.

d. Combination Treatment with Antimetabolites

Antimetabolites are chemotherapy treatments that are similar to normal substances within the cell. When cells incorporate the antimetabolites into the cellular metabolism, the cells are unable to divide. Antimetabolites are cell-cycle specific and attack cells at specific phases in the cell cycle.

In some examples, the peptidomimetic macrocycles of the disclosure are used in combination with one or more antimetabolites, such as a folic acid antagonist, pyrimidine antagonist, purine antagonist, or an adenosine deaminase inhibitor. In some embodiments, the peptidomimetic macrocycles of the disclosure are used in combination with an antimetabolite, such as methotrexate, 5-fluorouracil, foxuridine, cytarabine, capecitabine, gemcitabine, 6-mercaptopurine, 6-thioguanine, cladribine, fludarabine, nelarabine, or pentostatin. In some embodiments, the peptidomimetic macrocycles of the disclosure are used in combination with capecitabine (Xeloda®), gemcitabine (Gemzar®), or cytarabine (Cytosar-U®).

e. Combination Treatment with Plant Alkaloids

In some embodiments, the peptidomimetic macrocycles of the disclosure are used in combination with plant alkaloids. In some embodiments, the peptidomimetic macrocycles of the disclosure are used in combination with plant alkaloids, such as vinca alkaloids, taxanes, podophyllotoxins, or camptothecan analogues. In some embodiments, the peptidomimetic macrocycles of the disclosure are used in combination with plant alkaloids, such as vincristine, vinblastine, vinorelbine, paclitaxel, docetaxel, etoposide, tenisopide, irinotecan, or topotecan.

In some embodiments, the peptidomimetic macrocycles of the disclosure are used in combination with taxanes, such as paclitaxel (Abraxane® or Taxol®) and docetaxel (Taxotere®). In some embodiments, the peptidomimetic macrocycles of the instant disclosure are used in combination with paclitaxel. In some embodiments, the peptidomimetic macrocycles of the instant disclosure are used in combination with docetaxel.

f. Combination Treatment with Therapeutic Antibodies

In some embodiments, the peptidomimetic macrocycles of the disclosure are used in combination with therapeutic antibodies. In some embodiments, the peptidomimetic macrocycles of the disclosure are used in combination with naked monoclonal antibodies, such as alemtuzumab (Campath®) or trastuzumab (Herceptin®). In some embodiments, the peptidomimetic macrocycles of the disclosure are used in combination with conjugated monoclonal antibodies, such as radiolabeled antibodies or chemolabeled antibodies. In some embodiments, the peptidomimetic macrocycles of the disclosure are used in combination with conjugated monoclonal antibodies, such as ibritumomab tiuxetan (Zevalin®), brentuximab vedotin (Adcetris®), ado-trastuzumab emtansine (Kadcyla®), or denileukin diftitox (Ontak®). In some embodiments, the peptidomimetic macrocycles of the disclosure are used in combination with bispecific monoclonal antibodies, such as blinatumomab (Blincyto®).

In some embodiments, the peptidomimetic macrocycles of the disclosure are used in combination with an anti-CD20 antibody, such as rituximab (Mabthera®/Rituxan®), obinutuzumab (Gazyva®), ibritumomab tiuxetan, tositumomab, ofatumumab (Genmab®), ocaratuzumab, ocrelizumab, TRU-015, or veltuzumab. Other antibodies that can be used in combination with the peptidomimetic macrocycles of the disclosure include antibodies against the programed cell death (PD-1) receptor, for example pembrolizumab (Keytruda®) or nivolumba (Opdivo®).

g. Combination Treatment with PD-L1 and/or PD-1 Antagonists

The PD-1 pathway comprises the immune cell co-receptor Programmed Death-1 (PD-1) and the PD-1 ligands PD-L1 and PD-L2. The PD-1 pathway mediates local immunosuppression in the tumor microenvironment. PD-1 and PD-L1 antagonists suppress the immune system. In some embodiments, a PD-1 or PD-L1 antagonist is a monoclonal antibody or antigen binding fragment thereof that specifically binds to, blocks, or downregulates PD-1 or PD-L1, respectively. In some embodiments, a PD-1 or PD-L1 antagonist is a compound or biological molecule that specifically binds to, blocks, or downregulates PD-1 or PD-L1, respectively.

In some embodiments, the peptidomimetic macrocycles of the disclosure are used in combination with a PD-1 or PD-L1 antagonist. In some embodiments, the peptidomimetic macrocycles of the disclosure are used in combination with a PD-1/PD-L1 antagonist, for example, MK-3475, nivolumab (Opdivo®), pembrolizumab (Keytruda®), humanized antibodies (i.e., h409A11, h409A16 and h409A17), AMP-514, BMS-936559, MEDI0680, MEDI4736, MPDL3280A, MSB0010718C, MDX-1105, MDX-1106, or pidilzumab. In some embodiments, the peptidomimetic macrocycles of the disclosure are used in combination with a PD-1/PD-L1 antagonist that is an immunoadhesion molecule, such as AMP-224. In some embodiments, the peptidomimetic macrocycles of the disclosure are used in combination with a PD-1/PD-L1 antagonist to treat cancer cells or a tumor that overexpresses PD-1 or PD-L1. In some embodiments, the peptidomimetic macrocycles of the disclosure are used in combination with a PD-1/PD-L1 antagonist to treat cancer cells or a tumor that overexpresses miR-34.

h. Combination Treatment with Anti-Hormone Therapy

Anti-hormone therapy uses an agent to suppress selected hormones or the effects. Anti-hormone therapy is achieved by antagonizing the function of hormones with a hormone antagonist and/or by preventing the production of hormones. In some embodiments, the suppression of hormones can be beneficial to subjects with certain cancers that grow in response to the presence of specific hormones. In some embodiments, the peptidomimetic macrocycles of the disclosure are used in combination with a hormone antagonist.

In some embodiments, the peptidomimetic macrocycles of the disclosure are used in combination with anti-androgens, anti-estrogens, aromatase inhibitors, or luteinizing hormone-releasing hormone (LHRH) agonists. In some embodiments, the peptidomimetic macrocycles of the disclosure are used in combination with anti-androgens, such as bicalutamide (Casodex®), cyproterone (Androcur®), flutamide (Euflex®), or nilutamide (Anandron®). In some embodiments, the peptidomimetic macrocycles of the disclosure are used in combination with anti-estrogens, such as fulvestrant (Faslodex®), raloxifene (Evista®), or tamoxifen (Novaladex®, Tamofen®). In some embodiments, the peptidomimetic macrocycles of the disclosure are used in combination with LHRH agonists, such as buserelin (Suprefact®), goserelin (Zoladex®), or leuprolide (Lupron®, Lupron Depot®, Eligard®).

i. Combination Treatment with Hypomethylating (Demethylating) Agents

Hypomethylating (demethylating) agents inhibit DNA methylation, which affects cellular function through successive generations of cells without changing the underlying DNA sequence. Hypomethylating agents can block the activity of DNA methyltransferase. In some embodiments, the peptidomimetic macrocycles of the disclosure can be used in combination with hypomethylating agents, such as azacitidine (Vidaza®, Azadine®) or decitabine (Dacogen®).

j. Combination Treatment with Anti-Inflammatory Agents

In some embodiments, the peptidomimetic macrocycles of the disclosure can be used in combination with nonsteroidal anti-inflammatory drugs (NSAIDs), specific COX-2 inhibitors, or corticosteroids. In some embodiments, the peptidomimetic macrocycles of the disclosure can be used in combination with NSAIDs, such as aspirin, ibuprofen, naproxen, celecoxib, ketorolac, or diclofenac. In some embodiments, the peptidomimetic macrocycles of the disclosure can be used in combination with specific COX-2 inhibitors, such as celecoxib (Celebrex®), rofecoxib, or etoricoxib. In some embodiments, the peptidomimetic macrocycles of the disclosure can be used in combination with corticosteroids, such as dexamethasone or glucosteroids (e.g., hydrocortisone and prednisone).

k. Combination Treatment with HDAC Inhibitors

Histone deacetylase (HDAC) inhibitors are chemical compounds that inhibit histone deacetylase. HDAC inhibitors can induce p21 expression, a regulator of p53 activity. In some embodiments, the peptidomimetic macrocycles of the disclosure can be used in combination with an HDAC inhibitor. In some embodiments, the peptidomimetic macrocycles of the disclosure can be used in combination with an HDAC inhibitor, such as vorinostat, romidepsin (Istodax®), chidamide, panobinostat (Farydak®), belinostat (PDX101), panobinostat (LBH589), valproic acid, mocetinostat (MGCD0103), abexinostat (PCI-24781), entinostat (MS-275), SB939, resminostat (4SC-201), givinostat (ITF2357), quisinostat (JNJ-26481585), HBI-8000, kevetrin, CUDC-101, AR-42, CHR-2845, CHR-3996, 4SC-202, CG200745, ACY-1215, ME-344, sulforaphane, or trichostatin A.

l. Combination Treatment with Platinum-Based Antineoplastic Drugs

Platinum-based antineoplastic drugs are coordinated complex of platinum. In some embodiments, the peptidomimetic macrocycles of the disclosure can be used in combination with a platinum-based antineoplastic drug, such as cisplatin, oxaliplatin, carboplatin, nedaplatin, triplatin tetranitrate, phenanthriplatin, picoplatin, or satraplatin. In some embodiments, the peptidomimetic macrocycles of the disclosure can be used in combination with cisplatin or carboplatin. In some embodiments, the peptidomimetic macrocycles of the disclosure can be used in combination with cisplatinum, platamin, neoplatin, cismaplat, cis-diamminedichloroplatinum(II), or CDDP; Platinol®) and carboplatin (also known as cis-diammine(1,1-cyclobutanedicarboxylato)platinum (II); tradenames Paraplatin® and Paraplatin-AQ®).

m. Combination Treatment with Kinase Inhibitors

Abnormal activation of protein phosphorylation is frequently either a driver of direct consequence of cancer. Kinase signaling pathways are involved in the phenotypes of tumor biology, including proliferation, survival, motility, metabolism, angiogenesis, and evasion of antitumor immune responses.

MEK Inhibitors:

MEK inhibitors are drugs that inhibit the mitogen-activated protein kinase enzymes MEK1 and/or MEK2. In some embodiments, the peptidomimetic macrocycles of the disclosure can be used in combination with a MEK1 inhibitor. In some embodiments, the peptidomimetic macrocycles of the disclosure can be used in combination with a MEK2 inhibitor. In some embodiments, the peptidomimetic macrocycles of the disclosure can be used in combination with an agent that can inhibit MEK1 and MEK2. In some embodiments, the peptidomimetic macrocycles of the disclosure can be used in combination with a MEK1/MEK2 inhibitor, such as trametinib (Mekinist®), cobimetinib, binimetinib, selumetinib (AZD6244), pimasertib (AS-703026), PD-325901, CI-1040, PD035901, or TAK-733. In some embodiments, the peptidomimetic macrocycles of the disclosure are used in combination with trametinib. In some embodiments, the peptidomimetic macrocycles of the disclosure are used in combination with cobimetinib.

BRAF Inhibitors:

BRAF inhibitors are drugs that inhibit the serine/threonine-protein kinase B-raf (BRAF) protein. In some embodiments, the peptidomimetic macrocycles of the disclosure can be used in combination with a BRAF inhibitor. In some embodiments, the peptidomimetic macrocycles of the disclosure can be used in combination with a BRAF inhibitor that can inhibit wild type BRAF. In some embodiments, the peptidomimetic macrocycles of the disclosure can be used in combination with a BRAF inhibitor that can inhibit mutated BRAF. In some embodiments, the peptidomimetic macrocycles of the disclosure can be used in combination with a BRAF inhibitor that can inhibit V600E mutated BRAF. In some embodiments, the peptidomimetic macrocycles of the disclosure can be used in combination with a BRAF inhibitor, such as vemurafenib (Zelboraf®), dabrafenib (Tafinlar®), C-1, NVP-LGX818, or sorafenib (Nexavar®).

KRAS Inhibitors:

KRAS is a gene that acts as an on/off switch in cell signaling. In some embodiments, the peptidomimetic macrocycles of the disclosure can be used in combination with a KRAS inhibitor. In some embodiments, the peptidomimetic macrocycles of the disclosure can be used in combination with a wild type KRAS inhibitor. In some embodiments, the peptidomimetic macrocycles of the disclosure can be used in combination with a mutated KRAS inhibitor.

BTK Inhibitors:

Bruton's tyrosine kinase (BTK) is a non-receptor tyrosine kinase of the Tec kinase family that is involved in B-cell receptor signaling. In some embodiments, the peptidomimetic macrocycles of the disclosure can be used in combination with a BTK inhibitor. In some embodiments, the peptidomimetic macrocycles of the disclosure can be used in combination with a BTK inhibitor, such as ibrutinib or acalabrutinib.

CDK Inhibitors:

CDK4 and CDK6 are cyclin-dependent kinases that control the transition between the G1 and S phases of the cell cycle. CDK4/CDK6 activity is deregulated and overactive in cancer cells. Selective CDK4/CDK6 inhibitors can block cell-cycle progression in the mid-G1 phase of the cell cycle, causing arrest and preventing the proliferation of cancer cells. In some embodiments, the peptidomimetic macrocycles of the disclosure can be used in combination with a CDK4/CDK6 inhibitor. In some embodiments, the peptidomimetic macrocycles of the disclosure can be used in combination with a CDK4/CDK6 inhibitor, such as palbociclib (Ibrance®), ribociclib, trilaciclib, seliciclib, dinaciclib, milciclib, roniciclib, atuveciclib, briciclib, riviciclib, voruciclib, or abemaciclib. In some embodiments, the peptidomimetic macrocycles of the disclosure can be used in combination with palbociclib. In some embodiments, the peptidomimetic macrocycles of the disclosure can be used in combination with ribociclib. In some embodiments, the peptidomimetic macrocycles of the disclosure can be used in combination with abemaciclib.

In some examples, the peptidomimetic macrocycles of the disclosure may be used in combination with an inhibitor of CDK4 and/or CDK6 and with an agent that reinforces the cytostatic activity of CDK4/6 inhibitors and/or with an agent that converts reversible cytostasis into irreversible growth arrest or cell death. Exemplary cancer subtypes include NSCLC, melanoma, neuroblastoma, glioblastoma, liposarcoma, and mantle cell lymphoma. In some examples, the peptidomimetic macrocycles of the disclosure may also be used in combination with at least one additional pharmaceutically active agent that alleviates CDKN2A (cyclin-dependent kinase inhibitor 2A) deletion. In some examples, the peptidomimetic macrocycles of the disclosure may also be used in combination with at least one additional pharmaceutically active agent that alleviates CDK9 (cyclin-dependent kinase 9) abnormality.

In some embodiments, the peptidomimetic macrocycles of the disclosure can be used in combination with a CDK2, CDK7, and/or CDK9 inhibitor. In some embodiments, the peptidomimetic macrocycles of the disclosure can be used in combination with a CDK2, CDK7, or CDK9 inhibitor, such as seliciclib, voruciclib, or milciclib. In some embodiments, the peptidomimetic macrocycles of the disclosure can be used in combination with a CDK inhibitor, such as dinaciclib, roniciclib (Kisqali®), or briciclib. In some examples, the peptidomimetic macrocycles of the disclosure may also be used in combination with at least one additional pharmaceutically-active agent that alleviates CDKN2A (cyclin-dependent kinase inhibitor 2A) deletion.

In some embodiments, a method of treating cancer in a subject in need thereof can comprise administering to the subject a therapeutically effective amount of a p53 agent that inhibits the interaction between p53 and MDM2 and/or p53 and MDMX, and/or modulates the activity of p53 and/or MDM2 and/or MDMX; and at least one additional pharmaceutically-active agent, wherein the at least one additional pharmaceutically-active agent modulates the activity of CDK4 and/or CDK6, and/or inhibits CDK4 and/or CDK6.

ATM Regulators:

The peptidomimetic macrocycles of the disclosure may also be used in combination with one or more pharmaceutically-active agent that regulates the ATM (upregulate or downregulate). In some embodiments the compounds described herein can synergize with one or more ATM regulators. In some embodiments one or more of the compounds described herein can synergize with all ATM regulators.

AKT Inhibitors:

In some embodiments, the peptidomimetic macrocycles of the disclosure may be used in combination with one or more pharmaceutically-active agent that inhibits the AKT (protein kinase B (PKB)). In some embodiments the compounds described herein can synergize with one or more AKT inhibitors.

n. Combination Treatment with Other Pharmaceutically-Active Agents

In some examples, the peptidomimetic macrocycles of the disclosure may also be used in combination with at least one additional pharmaceutically-active agent that alleviates PTEN (phosphatase and tensin homolog) deletion.

In some examples, the peptidomimetic macrocycles of the disclosure may also be used in combination with at least one additional pharmaceutically-active agent that alleviates Wip-1Alpha over expression.

In some examples, the peptidomimetic macrocycles of the disclosure may be used in combination with at least one additional pharmaceutically-active agent that is a Nucleoside metabolic inhibitor. Exemplary nucleoside metabolic inhibitors that may be used include capecitabine, gemcitabine and cytarabine (Arac).

The table below lists suitable additional pharmaceutically-active agents for use with the methods described herein.

| Cancer Type | Drug name | Brand name | Drug works predominately in S or M phase |
|---|---|---|---|
| ALL | ABT-199 | none | No |
| ALL | clofarabine | Clofarex | Yes; S phase |
| ALL | cyclophosphamide | Clafen, Cytoxan, Neosar | Yes: S phase |
| ALL | cytarabine | Cytosar-U, Tarabine PFS | Yes: S phase |
| ALL | doxorubicin | Adriamycin | Yes: S phase |
| ALL | imatinib mesylate | Gleevec | No |
| ALL | methotrexate | Abitrexate, Mexate, Folex | Yes: S phase |
| ALL | prednisone | Deltasone, Medicorten | No |
| ALL | romidepsin | Istodax | |
| ALL | vincristine | Vincasar | Yes: M phase |
| AML | ABT-199 | none | No |
| AML | azacitadine | Vidaza | No |
| AML | cyclophosphamide | Clafen, Cytoxan, Neosar | Yes: S phase |
| AML | cytarabine | Cytosar-U, Tarabine PFS | Yes: S phase |
| AML | decitabine | Dacogen | No |
| AML | doxorubicin | Adriamycin | Yes: S phase |
| AML | etoposide | Etopophos, Vepesid | Yes: S and M phases |
| AML | vincristine | Vincasar | Yes: M phase |
| bone | doxorubicin | Adriamycin | Yes: S phase |
| bone | methotrexate | Abitrexate, Mexate, Folex | Yes: S phase |
| breast | capecitabine | Xeloda | Yes: S phase |
| breast | cyclophosphamide | Clafen, Cytoxan, Neosar | Yes: S phase |
| breast | docetaxel | Taxotere | Yes: M phase |
| breast | doxorubicin | Adriamycin | Yes: S phase |
| breast | eribulin mesylate | Haliben | Yes: M phase |
| breast | everolimus | Afinitor | No |
| breast | exemestane | Aromasin | No |
| breast | fluorouracil | Adrucil, Efudex | Yes: S phase |
| breast | fulvestrant | Faslofex | |
| breast | gemcitabine | Gemzar | Yes: S phase |
| breast | goserelin acetate | Zoladex | No |
| breast | letrozole | Femara | No |
| breast | megestrol acetate | Megace | No |
| breast | methotrexate | Abitrexate, Mexate, Folex | Yes: S phase |
| breast | paclitaxel | Abraxane ®, Taxol | Yes: M phase |
| breast | palbociclib | Ibrance | Might cause G1 arrest |
| breast | pertuzumab | Perjeta | No |
| breast | tamoxifen citrate | Nolvadex | No |
| breast | trastuzumab | Herceptin, Kadcyla | No |
| colon | capecitabine | Xeloda | Yes: S phase |
| colon | cetuximab | Erbitux | No |
| colon | fluorouracil | Adrucil, Efudex | Yes: S phase |
| colon | irinotecan | camptosar | Yes: S and M phases |
| colon | ramucirumab | Cyramza | No |
| endometrial | carboplatin | Paraplatin, Paraplat | Yes: S phase |
| endometrial | cisplatin | Platinol | Yes: S phase |
| endometrial | doxorubicin | Adriamycin | Yes: S phase |
| endometrial | megestrol acetate | Megace | No |
| endometrial | paclitaxel | Abraxane ®, Taxol | Yes: M phase |
| gastric | docetaxel | Taxotere | Yes: M phase |

-continued

| Cancer Type | Drug name | Brand name | Drug works predominately in S or M phase |
|---|---|---|---|
| gastric | doxorubicin | Adriamycin | Yes: S phase |
| gastric | fluorouracil | Adrucil, Efudex | Yes: S phase |
| gastric | ramucirumab | Cyramza | No |
| gastric | trastuzumab | Herceptin | No |
| kidney | axitinib | Inlyta | No |
| kidney | everolimus | Afinitor | No |
| kidney | pazopanib | Votrient | No |
| kidney | sorafenib tosylate | Nexavar | No |
| liver | sorafenib tosylate | Nexavar | No |
| melanoma | dacarbazine | DTIC, DTIC-Dome | Yes: S phase |
| melanoma | paclitaxel | Abraxane ®, Taxol | Yes: M phase |
| melanoma | trametinib | Mekinist | No |
| melanoma | vemurafenib | Zelboraf | No |
| melanoma | dabrafenib | Taflinar | |
| mesothelioma | cisplatin | Platinol | Yes: S phase |
| mesothelioma | pemetrexed | Alimta | Yes: S phase |
| NHL | ABT-199 | none | No |
| NHL | bendamustine | Treanda | Causes DNA crosslinking, but is also toxic to resting cells |
| NHL | bortezomib | Velcade | No |
| NHL | brentuximab vedotin | Adcetris | Yes: M phase |
| NHL | chlorambucil | Ambochlorin, Leukeran, Linfolizin | Yes: S phase |
| NHL | cyclophosphamide | Clafen, Cytoxan, Neosar | Yes: S phase |
| NHL | dexamethasone | Decadrone, Dexasone | No |
| NHL | doxorubicin | Adriamycin | Yes: S phase |
| NHL | Ibrutinib | Imbruvica | No |
| NHL | lenalidomide | Revlimid | No |
| NHL | methotrexate | Abitrexate, Mexate, Folex | Yes: S phase |
| NHL | obinutuzumab | Gazyva | No |
| NHL | prednisone | Deltasone, Medicorten | No |
| NHL | romidepsin | Istodax | |
| NHL | rituximab | Rituxan | No |
| NHL | vincristine | Vincasar | Yes: M phase |
| NSCLC | afatinib Dimaleate | Gilotrif | No |
| NSCLC | carboplatin | Paraplatin, Paraplat | Yes: S phase |
| NSCLC | cisplatin | Platinol | Yes: S phase |
| NSCLC | crizotinib | Xalkori | No |
| NSCLC | docetaxel | Taxotere | Yes: M phase |
| NSCLC | erlotinib | Tarceva | No |
| NSCLC | gemcitabine | Gemzar | Yes: S phase |
| NSCLC | methotrexate | Abitrexate, Mexate, Folex | Yes: S phase |
| NSCLC | paclitaxel | Abraxane ®, Taxol | Yes: M phase |
| NSCLC | palbociclib | Ibrance | Might cause G1 arrest |
| NSCLC | pemetrexed | Alimta | Yes: S phase |
| NSCLC | ramucirumab | Cyramza | No |
| ovarian | carboplatin | Paraplatin, Paraplat | Yes: S phase |
| ovarian | cisplatin | Platinol | Yes; S phase |
| ovarian | cyclophosphamide | Clafen, Cytoxan, Neosar | Yes: S phase |
| ovarian | gemcitabine | Gemzar | Yes: S phase |
| ovarian | olaparib | Lynparza | Yes: G2/M phase arrest |
| ovarian | paclitaxel | Abraxane ®, Taxol | Yes: M phase |
| ovarian | topotecan | Hycamtin | Yes: S phase |
| prostate | abiraterone | Zytiga | No |
| prostate | cabazitaxel | Jevtana | Yes: M phase |
| prostate | docetaxel | Taxotere | Yes: M phase |
| prostate | enzalutamide | Xtandi | No |
| prostate | goserelin acetate | Zoladex | No |
| prostate | prednisone | Deltasone, Medicorten | No |
| soft tissue sarcoma | doxorubicin | Adriamycin | Yes: S phase |
| soft tissue sarcoma | imatinib mesylate | Gleevec | No |
| soft tissue sarcoma | pazopanib | Votrient | No |
| T-cell lymphoma | romidepsin | Istodax | |

Administration of Combination Treatment

The peptidomimetic macrocycles or a composition comprising same and the at least one additional pharmaceutically-active agent, for example, any additional therapeutic agent described herein, or a composition comprising same can be administered simultaneously (i.e., simultaneous administration) and/or sequentially (i.e., sequential administration).

According to certain embodiments, the peptidomimetic macrocycles and the at least one additional pharmaceutically-active agent, for example, any additional therapeutic agent described herein, are administered simultaneously, either in the same composition or in separate compositions. The term "simultaneous administration," as used herein, means that the peptidomimetic macrocycle and the at least one additional pharmaceutically-active agent, for example, any additional therapeutic agent described herein, are administered with a time separation of no more than a few minutes, for example, less than about 15 minutes, less than about 10, less than about 5, or less than about 1 minute. When the drugs are administered simultaneously, the peptidomimetic macrocycle and the at least one additional pharmaceutically-active agent, for example, any additional therapeutic agent described herein, may be contained in the same composition (e.g., a composition comprising both the peptidomimetic macrocycle and the at least additional pharmaceutically-active agent) or in separate compositions (e.g., the peptidomimetic macrocycle is contained in one composition and the at least additional pharmaceutically-active agent is contained in another composition).

According to other embodiments, the peptidomimetic macrocycles and the at least one additional pharmaceutically-active agent, for example, any additional therapeutic agent described herein, are administered sequentially, i.e., the peptidomimetic macrocycle is administered either prior to or after the administration of the additional pharmaceutically-active agent. The term "sequential administration" as used herein means that the peptidomimetic macrocycle and the additional pharmaceutically-active agent, for example, any additional therapeutic agent described herein, are administered with a time separation of more than a few minutes, for example, more than about 15 minutes, more than about 20 or more minutes, more than about 30 or more minutes, more than about 40 or more minutes, more than about 50 or more minutes, or more than about 60 or more minutes. In some embodiments, the peptidomimetic macrocycle is administered before the additional pharmaceutically-active agent, for example, any additional therapeutic agent described herein. In some embodiments, the pharmaceutically-active agent, for example, any additional therapeutic agent described herein, is administered before the peptidomimetic macrocycle. The peptidomimetic macrocycle and the additional pharmaceutically-active agent, for example, any additional therapeutic agent described herein, are contained in separate compositions, which may be contained in the same or different packages.

In some embodiments, the administration of the peptidomimetic macrocycles and the additional pharmaceutically-active agent, for example, any additional therapeutic agent described herein, are concurrent, i.e., the administration period of the peptidomimetic macrocycles and that of the agent overlap with each other. In some embodiments, the administration of the peptidomimetic macrocycles and the additional pharmaceutically-active agent, for example, any additional therapeutic agent described herein, are non-concurrent. For example, in some embodiments, the administration of the peptidomimetic macrocycles is terminated before the additional pharmaceutically-active agent, for example, any additional therapeutic agent described herein, is administered. In some embodiments, the administration of the additional pharmaceutically-active agent, for example, any additional therapeutic agent described herein, is terminated before the peptidomimetic macrocycle is administered. The time period between these two non-concurrent administrations can range from being days apart to being weeks apart.

The dosing frequency of the peptidomimetic macrocycle and the at least one additional pharmaceutically-active agent, for example, any additional therapeutic agent described herein, may be adjusted over the course of the treatment, based on the judgment of the administering physician. When administered separately, the peptidomimetic macrocycle and the at least one additional pharmaceutically-active agent, for example, any additional therapeutic agent described herein, can be administered at different dosing frequency or intervals. For example, the peptidomimetic macrocycle can be administered weekly, while the at least one additional pharmaceutically-active agent, for example, any additional therapeutic agent described herein, can be administered more or less frequently. Or, the peptidomimetic macrocycle can be administered twice weekly, while the at least one additional pharmaceutically-active agent, for example, any additional therapeutic agent described herein, can be administered more or less frequently. In addition, the peptidomimetic macrocycle and the at least one additional pharmaceutically-active agent, for example, any additional therapeutic agent described herein, can be administered using the same route of administration or using different routes of administration.

A therapeutically effective amount of a peptidomimetic macrocycle and/or the additional pharmaceutically-active agent, for example, any additional therapeutic agent described herein, for use in therapy can vary with the nature of the condition being treated, the length of treatment time desired, the age and the condition of the patient, and can be determined by the attending physician. Doses employed for human treatment can be in the range of about 0.01 mg/kg to about 1000 mg/kg per day (e.g., about 0.01 mg/kg to about 100 mg/kg per day, about 0.01 mg/kg to about 10 mg/kg per day, about 0.1 mg/kg to about 100 mg/kg per day, about 0.1 mg/kg to about 50 mg/kg per day, about 0.1 mg/kg to about 10 mg/kg per day) of one or each component of the combinations described herein. In some embodiments, doses of a peptidomimetic macrocycle employed for human treatment are in the range of about 0.01 mg/kg to about 100 mg/kg per day (e.g., about 0.01 mg/kg to about 10 mg/kg per day, about 0.1 mg/kg to about 100 mg/kg per day, about 0.1 mg/kg to about 50 mg/kg per day, about 0.1 mg/kg to about 10 mg/kg per day, about 1 mg/kg per day). In some embodiments, doses of the additional pharmaceutically-active agent, for example, any additional therapeutic agent described herein, employed for human treatment can be in the range of about 0.01 mg/kg to about 100 mg/kg per day (e.g., about 0.1 mg/kg to about 100 mg/kg per day, about 0.1 mg/kg to about 50 mg/kg per day, about 10 mg/kg per day or about 30 mg/kg per day). The desired dose may be conveniently administered in a single dose, or as multiple doses administered at appropriate intervals, for example as two, three, four or more sub-doses per day.

In some embodiments, such as when given in combination with the at least one additional pharmaceutically active agent, for example, any additional therapeutic agent described herein, the dosage of a peptidomimetic macrocycle may be given at relatively lower dosages. In some embodiments, the dosage of a peptidomimetic macrocycle may be from about 1 ng/kg to about 100 mg/kg. The dosage of a peptidomimetic macrocycle may be at any dosage including, but not limited to, about 1 mg/kg, 25 mg/kg, 50 µg/kg, 75 µg/kg, 100µ µg/kg, 125 µg/kg, 150 µg/kg, 175 µg/kg, 200 µg/kg, 225 µg/kg, 250 mg/kg, 275 mg/kg, 300 µg/kg, 325 µg/kg, 350 µg/kg, 375 µg/kg, 400 µg/kg, 425 µg/kg, 450 µg/kg, 475 µg/kg, 500 µg/kg, 525 µg/kg, 550 µg/kg, 575 µg/kg, 600 µg/kg, 625 µg/kg, 650 µg/kg, 675 mg/kg, 700 mg/kg, 725 µg/kg, 750 µg/kg, 775 µg/kg, 800 µg/kg, 825 mg/kg, 850 mg/kg, 875 µg/kg, 900 µg/kg, 925 µg/kg, 950 mg/kg, 975 mg/kg, 1 mg/kg, 2.5 mg/kg, 5 mg/kg, 10 mg/kg, 15 mg/kg, 20 mg/kg, 25 mg/kg, 30 mg/kg, 35 mg/kg, 40 mg/kg, 45 mg/kg, 50 mg/kg, 60 mg/kg, 70 mg/kg, 80 mg/kg, 90 mg/kg, or 100 mg/kg.

In some embodiments, the dosage of the additional pharmaceutically-active agent, for example, any additional therapeutic agent described herein, may be from about 1 ng/kg to about 100 mg/kg. The dosage of the additional pharmaceutically-active agent may be at any dosage including, but not limited to, about 1 mg/kg, 25 mg/kg, 50 µg/kg, 75 µg/kg, 100µ µg/kg, 125 mg/kg, 150 mg/kg, 175 µg/kg, 200 µg/kg, 225 mg/kg, 250 mg/kg, 275 µg/kg, 300 µg/kg, 325 µg/kg, 350 µg/kg, 375 mg/kg, 400 mg/kg, 425 µg/kg, 450 µg/kg, 475 µg/kg, 500 mg/kg, 525 mg/kg, 550 µg/kg, 575 µg/kg, 600 µg/kg, 625 µg/kg, 650 mg/kg, 675 mg/kg, 700 µg/kg, 725 µg/kg, 750 µg/kg, 775 µg/kg, 800 mg/kg, 825 mg/kg, 850 µg/kg, 875 µg/kg, 900 µg/kg, 925 mg/kg, 950 mg/kg, 975 µg/kg, 1 mg/kg, 2.5 mg/kg, 5 mg/kg, 10 mg/kg, 15 mg/kg, 20 mg/kg, 25 mg/kg, 30 mg/kg, 35 mg/kg, 40 mg/kg, 45 mg/kg, 50 mg/kg, 60 mg/kg, 70 mg/kg, 80 mg/kg, 90 mg/kg, or 100 mg/kg.

In some embodiments, the dosage of the additional pharmaceutically-active agent is about 1 mg to about 250 mg. In some embodiments, the dosage of the additional pharmaceutically-active agent is about 1 mg to about 25 mg, about 1 mg to about 50 mg, about 1 mg to about 75 mg, about 1 mg to about 100 mg, about 1 mg to about 125 mg, about 1 mg to about 150 mg, about 1 mg to about 200 mg, about 1 mg to about 250 mg, about 25 mg to about 50 mg, about 25 mg to about 75 mg, about 25 mg to about 100 mg, about 25 mg to about 125 mg, about 25 mg to about 150 mg, about 25 mg to about 200 mg, about 25 mg to about 250 mg, about 50 mg to about 75 mg, about 50 mg to about 100 mg, about 50 mg to about 125 mg, about 50 mg to about 150 mg, about 50 mg to about 200 mg, about 50 mg to about 250 mg, about 75 mg to about 100 mg, about 75 mg to about 125 mg, about 75 mg to about 150 mg, about 75 mg to about 200 mg, about 75 mg to about 250 mg, about 100 mg to about 125 mg, about 100 mg to about 150 mg, about 100 mg to about 200 mg, about 100 mg to about 250 mg, about 125 mg to about 150 mg, about 125 mg to about 200 mg, about 125 mg to about 250 mg, about 150 mg to about 200 mg, about 150 mg to about 250 mg, or about 200 mg to about 250 mg. In some embodiments, the dosage of the additional pharmaceutically-active agent is about 1 mg, about 25 mg, about 50 mg, about 75 mg, about 100 mg, about 125 mg, about 150 mg, about 200 mg, or about 250 mg. In some embodiments, the dosage of the additional pharmaceutically-active agent is at least about 1 mg, about 25 mg, about 50 mg, about 75 mg, about 100 mg, about 125 mg, about 150 mg, or about 200 mg. In some embodiments, the dosage of the additional pharmaceutically-active agent is at most about 25 mg, about 50 mg, about 75 mg, about 100 mg, about 125 mg, about 150 mg, about 200 mg, or about 250 mg. In some embodiments the additional pharmaceutically-active agent is a cyclin dependent kinase inhibitor such as, for example, palbociclib.

In some embodiments, the dosage of the additional pharmaceutically-active agent is the approved dosage from the label of the additional pharmaceutically-active agent. In some embodiments, the dosage of the additional pharmaceutically-active agent is 600 mg of ribociclib; 150 mg or 200 mg of abemaciclib; 125 mg of palbociclib; 2 mg of trametinib; 175 mg/m$^2$, 135 mg/m$^2$, or 100 mg/m$^2$ of paclitaxel; 1.4 mg/m$^2$ of eribulin; 250 mg/m$^2$ (breast cancer), 100 mg/m$^2$ (non-small cell lung cancer), or 125 mg/m$^2$ (pancreatic cancer) of Abraxane®; 200 mg of Keytruda®; or 240 mg or 480 mg of Opdivo®, or a pharmaceutically-acceptable salt of any of the foregoing. In some embodiments, the approved dosages of the additional pharmaceutically-active agents can be reduced to address adverse side effects such as renal impairment or liver impairment.

The peptidomimetic macrocycle and the additional pharmaceutically-active agent, for example, any additional therapeutic agent described herein, can be provided in a single unit dosage form for being taken together or as separate entities (e.g. in separate containers) to be administered simultaneously or with a certain time difference. This time difference may be between 1 hour and 1 month, e.g., between 1 day and 1 week, e.g., 48 hours and 3 days. In addition, it is possible to administer the peptidomimetic macrocycle via another administration way than the additional pharmaceutically-active agent, for example, any additional therapeutic agent described herein. For example, it may be advantageous to administer either the peptidomimetic macrocycle or the additional pharmaceutically-active agent, for example, any additional therapeutic agent described herein, intravenously and the other systemically or orally. For example, the peptidomimetic macrocycle is administered intravenously and the additional pharmaceutically-active agent orally.

In some embodiments, the peptidomimetic macrocycle is administered about 0.1 hour, 0.2 hour, 0.3 hour, 0.4 hour, 0.5 hour, 0.6 hour, 0.7 hour, 0.8 hour, 0.9 hour, 1 hour, 2 hours, 3 hours, 4 hours, 5 hours, 6 hours, 7 hours, 8 hours, 9 hours, 10 hours, 11 hours, 12 hours, 1 day, 2 days, 3 days, 4 days, 5 days, 6 days, 7 days, 8 days, 9 days, 10 days, 11 days, 12 days, 13 days, 14 days, 15 days, 16 days, 17 days, 18 days, 19 days, 20 days, 21 days, 22 days, 23 days, 24 days, 25 days, 26 days, 27 days, 28 days, 29 days, 30 days, 1 month, 2 months, 3 months, 4 months, 5 months, 6 months, 7 months, 8 months, 9 months, 10 months, 11 months, or 12 months before the additional pharmaceutically-active agent, for example, any additional therapeutic agent described herein, is administered. In some embodiments, the peptidomimetic macrocycle is administered about 6 hours before the additional pharmaceutically-active agent, for example, any additional therapeutic agent described herein, is administered.

In some embodiments, the peptidomimetic macrocycle is administered about 0.1 hour, 0.2 hour, 0.3 hour, 0.4 hour, 0.5 hour, 0.6 hour, 0.7 hour, 0.8 hour, 0.9 hour, 1 hour, 2 hours, 3 hours, 4 hours, 5 hours, 6 hours, 7 hours, 8 hours, 9 hours, 10 hours, 11 hours, 12 hours, 1 day, 2 days, 3 days, 4 days, 5 days, 6 days, 7 days, 8 days, 9 days, 10 days, 11 days, 12 days, 13 days, 14 days, 15 days, 16 days, 17 days, 18 days, 19 days, 20 days, 21 days, 22 days, 23 days, 24 days, 25 days, 26 days, 27 days, 28 days, 29 days, 30 days, 1 month, 2 months, 3 months, 4 months, 5 months, 6 months, 7 months, 8 months, 9 months, 10 months, 11 months, or 12 months after the additional pharmaceutically-active agent, for example, any additional therapeutic agent described herein, is administered. In some embodiments, the peptidomimetic macrocycle is administered about 6 hours after the additional pharmaceutically-active agent, for example, any additional therapeutic agent described herein, is administered.

In some embodiments, the peptidomimetic macrocycle is administered chronologically before the additional pharmaceutically-active agent, for example, any additional therapeutic agent described herein. In some embodiments, the peptidomimetic macrocycle is administered from 1-24 hours, 2-24 hours, 3-24 hours, 4-24 hours, 5-24 hours, 6-24 hours, 7-24 hours, 8-24 hours, 9-24 hours, 10-24 hours, 11-24 hours, 12-24 hours, 1-30 days, 2-30 days, 3-30 days, 4-30 days, 5-30 days, 6-30 days, 7-30 days, 8-30 days, 9-30 days, 10-30 days, 11-30 days, 12-30 days, 13-30 days, 14-30 days, 15-30 days, 16-30 days, 17-30 days, 18-30 days, 19-30 days, 20-30 days, 21-30 days, 22-30 days, 23-30 days, 24-30 days, 25-30 days, 26-30 days, 27-30 days, 28-30 days, 29-30 days, 1-4 week, 2-4 weeks, 3-4 weeks, 1-12 months, 2-12 months, 3-12 months, 4-12 months, 5-12 months, 6-12 months, 7-12 months, 8-12 months, 9-12 months, 10-12 months, 11-12 months, or any combination thereof, before the additional pharmaceutically-active agent, for example, any additional therapeutic agent described herein, is administered. In some embodiments, the peptidomimetic macrocycle is administered at least 1 hour, 2 hours, 3 hours, 4 hours, 5 hours, 6 hours, 7 hours, 8 hours, 9 hours, 10 hours, 11 hours, 12 hours, 1 day, 2 days, 3 days, 4 days, 5 days, 6 days, 7 days, 8 days, 9, days, 10 days, 11 days, 12 days, 13 days, 14 days, 15 days, 16 days, 17 days, 18 days, 19 days, 20 days, 21 days, 22 days, 23 days, 24 days, 25 days, 26 days, 27 days, 28 days, 29 days, 1 week, 2 weeks, three weeks, 4 weeks, 1 month, 2 months, 3 months, 4 months, 5 months, 6 months, 7 months, 8 months, 9 months, 10 months, 11 months, 12 months, or any combination thereof, before the additional pharmaceutically-active agent, for example, any additional therapeutic agent described herein, is administered. For example, the peptidomimetic macrocycle can be administered at least 6 hours before a CDKI (e.g., seliciclib, ribociclib, abemaciclib, or palbociclib) is administered.

In some embodiments, the peptidomimetic macrocycle is administered at most 1 hour, 2 hours, 3 hours, 4 hours, 5 hours, 6 hours, 7 hours, 8 hours, 9 hours, 10 hours, 11 hours, 12 hours, 1 day, 2 days, 3 days, 4 days, 5 days, 6 days, 7 days, 8 days, 9, days, 10 days, 11 days, 12 days, 13 days, 14 days, 15 days, 16 days, 17 days, 18 days, 19 days, 20 days, 21 days, 22 days, 23 days, 24 days, 25 days, 26 days, 27 days, 28 days, 29 days, 1 week, 2 weeks, three weeks, 4 weeks, 1 month, 2 months, 3 months, 4 months, 5 months, 6 months, 7 months, 8 months, 9 months, 10 months, 11 months, 12 months, or any combination thereof, before the additional pharmaceutically-active agent is administered. For example, the peptidomimetic macrocycle can be administered at most 1 hour, 2 hours, 3 hours, 4 hours, 5 hours, 6 hours, 7 hours, 8 hours, 9 hours, 10 hours, 11 hours, 12 hours, 1 day, 2 days, 3 days, 4 days, 5 days, 6 days, 7 days, 8 days, 9, days, 10 days, 11 days, 12 days, 13 days, 14 days, 15 days, 16 days, 17 days, 18 days, 19 days, 20 days, 21 days, 22 days, 23 days, 24 days, 25 days, 26 days, 27 days, 28 days, 29 days, 1 week, 2 weeks, three weeks, 4 weeks, 1 month, 2 months, 3 months, 4 months, 5 months, 6 months, 7 months, 8 months, 9 months, 10 months, 11 months, 12 months, or any combination thereof, before a CDKI (e.g., seliciclib, ribociclib, abemaciclib, or palbociclib) is administered.

In some embodiments, the peptidomimetic macrocycle is administered about 1 hour, 2 hours, 3 hours, 4 hours, 5 hours, 6 hours, 7 hours, 8 hours, 9 hours, 10 hours, 11 hours, 12 hours, 1 day, 2 days, 3 days, 4 days, 5 days, 6 days, 7 days, 8 days, 9, days, 10 days, 11 days, 12 days, 13 days, 14 days, 15 days, 16 days, 17 days, 18 days, 19 days, 20 days, 21 days, 22 days, 23 days, 24 days, 25 days, 26 days, 27 days, 28 days, 29 days, 1 week, 2 weeks, three weeks, 4 weeks, 1 month, 2 months, 3 months, 4 months, 5 months, 6 months, 7 months, 8 months, 9 months, 10 months, 11 months, 12 months, or any combination thereof, before the additional pharmaceutically-active agent, for example, any additional therapeutic agent described herein, is administered. For example, the peptidomimetic macrocycle can be administered about 1 hour, 2 hours, 3 hours, 4 hours, 5 hours, 6 hours, 7 hours, 8 hours, 9 hours, 10 hours, 11 hours, 12 hours, 1 day, 2 days, 3 days, 4 days, 5 days, 6 days, 7 days, 8 days, 9, days, 10 days, 11 days, 12 days, 13 days, 14 days, 15 days, 16 days, 17 days, 18 days, 19 days, 20 days, 21 days, 22 days, 23 days, 24 days, 25 days, 26 days, 27 days, 28 days, 29 days, 1 week, 2 weeks, three weeks, 4 weeks, 1 month, 2 months, 3 months, 4 months, 5 months, 6 months, 7 months, 8 months, 9 months, 10 months, 11 months, 12 months, or any combination thereof, before a CDKI (e.g., seliciclib, ribociclib, abemaciclib, or palbociclib) is administered.

In some embodiments, the peptidomimetic macrocycle is administered chronologically at the same time as the at least one additional pharmaceutically active agent, for example, any additional therapeutic agent described herein.

In some embodiments, the peptidomimetic macrocycle is administered chronologically after the additional pharmaceutically-active agent, for example, any additional therapeutic agent described herein. In some embodiments, the additional pharmaceutically-active agent, for example, any additional therapeutic agent described herein, is administered from 1-24 hours, 2-24 hours, 3-24 hours, 4-24 hours, 5-24 hours, 6-24 hours, 7-24 hours, 8-24 hours, 9-24 hours, 10-24 hours, 11-24 hours, 12-24 hours, 1-30 days, 2-30 days, 3-30 days, 4-30 days, 5-30 days, 6-30 days, 7-30 days, 8-30 days, 9-30 days, 10-30 days, 11-30 days, 12-30 days, 13-30 days, 14-30 days, 15-30 days, 16-30 days, 17-30 days, 18-30 days, 19-30 days, 20-30 days, 21-30 days, 22-30 days, 23-30 days, 24-30 days, 25-30 days, 26-30 days, 27-30 days, 28-30 days, 29-30 days, 1-4 week, 2-4 weeks, 3-4 weeks, 1-12 months, 2-12 months, 3-12 months, 4-12 months, 5-12 months, 6-12 months, 7-12 months, 8-12 months, 9-12 months, 10-12 months, 11-12 months, or any combination thereof, before the peptidomimetic macrocycle is administered. In some embodiments the additional pharmaceutically-active agent is administered at least 1 hour, 2 hours, 3 hours, 4 hours, 5 hours, 6 hours, 7 hours, 8 hours, 9 hours, 10 hours, 11 hours, 12 hours, 1 day, 2 days, 3 days, 4 days, 5 days, 6 days, 7 days, 8 days, 9, days, 10 days, 11 days, 12 days, 13 days, 14 days, 15 days, 16 days, 17 days, 18 days, 19 days, 20 days, 21 days, 22 days, 23 days, 24 days, 25 days, 26 days, 27 days, 28 days, 29 days, 30 days, 1 week, 2 weeks, three weeks, 4 weeks, 1 month, 2 months, 3 months, 4 months, 5 months, 6 months, 7 months, 8 months, 9 months, 10 months, 11 months, 12 months, or any combination thereof, before the peptidomimetic macrocycle is administered. For example, seliciclib, ribociclib, abemaciclib, or palbociclib can be administered at least 1 hour, 2 hours, 3 hours, 4 hours, 5 hours, 6 hours, 7 hours, 8 hours, 9 hours, 10 hours, 11 hours, 12 hours, 1 day, 2 days, 3 days, 4 days, 5 days, 6 days, 7 days, 8 days, 9, days, 10 days, 11 days, 12 days, 13 days, 14 days, 15 days, 16 days, 17 days, 18 days, 19 days, 20 days, 21 days, 22 days, 23 days, 24 days, 25 days, 26 days, 27 days, 28 days, 29 days, 30 days, 1 week, 2 weeks, 3 weeks, 4 weeks, 1 month, 2 months, 3 months, 4 months, 5 months, 6 months, 7 months, 8 months, 9 months, 10 months, 11 months, 12 months, or any combination thereof, before the peptidomimetic macrocycle is administered.

In some embodiments, a CDKI is administered at most 1 hour, 2 hours, 3 hours, 4 hours, 5 hours, 6 hours, 7 hours, 8 hours, 9 hours, 10 hours, 11 hours, 12 hours, 1 day, 2 days, 3 days, 4 days, 5 days, 6 days, 7 days, 8 days, 9, days, 10 days, 11 days, 12 days, 13 days, 14 days, 15 days, 16 days, 17 days, 18 days, 19 days, 20 days, 21 days, 22 days, 23 days, 24 days, 25 days, 26 days, 27 days, 28 days, 29 days, 30 days, 1 week, 2 weeks, three weeks, 4 weeks, 1 month, 2 months, 3 months, 4 months, 5 months, 6 months, 7 months, 8 months, 9 months, 10 months, 11 months, 12 months, or any combination thereof, before the peptidomimetic macrocycle is administered. For example, seliciclib, ribociclib, abemaciclib, or palbociclib can be administered at most 1 hour, 2 hours, 3 hours, 4 hours, 5 hours, 6 hours, 7 hours, 8 hours, 9 hours, 10 hours, 11 hours, 12 hours, 1 day, 2 days, 3 days, 4 days, 5 days, 6 days, 7 days, 8 days, 9, days, 10 days, 11 days, 12 days, 13 days, 14 days, 15 days, 16 days, 17 days, 18 days, 19 days, 20 days, 21 days, 22 days, 23 days, 24 days, 25 days, 26 days, 27 days, 28 days, 29 days, 30 days, 1 week, 2 weeks, 3 weeks, 4 weeks, 1 month, 2 months, 3 months, 4 months, 5 months, 6 months, 7 months, 8 months, 9 months, 10 months, 11 months, 12 months, or any combination thereof, before the peptidomimetic macrocycle is administered.

In some embodiments a CDKI is administered about 1 hour, 2 hours, 3 hours, 4 hours, 5 hours, 6 hours, 7 hours, 8 hours, 9 hours, 10 hours, 11 hours, 12 hours, 1 day, 2 days, 3 days, 4 days, 5 days, 6 days, 7 days, 8 days, 9, days, 10 days, 11 days, 12 days, 13 days, 14 days, 15 days, 16 days, 17 days, 18 days, 19 days, 20 days, 21 days, 22 days, 23 days, 24 days, 25 days, 26 days, 27 days, 28 days, 29 days, 30 days, 1 week, 2 weeks, three weeks, 4 weeks, 1 month, 2 months, 3 months, 4 months, 5 months, 6 months, 7 months, 8 months, 9 months, 10 months, 11 months, 12 months, or any combination thereof, before the peptidomimetic macrocycle is administered. For example, seliciclib, ribociclib, abemaciclib, or palbociclib can be administered about 1 hour, 2 hours, 3 hours, 4 hours, 5 hours, 6 hours, 7 hours, 8 hours, 9 hours, 10 hours, 11 hours, 12 hours, 1 day, 2 days, 3 days, 4 days, 5 days, 6 days, 7 days, 8 days, 9, days, 10 days, 11 days, 12 days, 13 days, 14 days, 15 days, 16 days, 17 days, 18 days, 19 days, 20 days, 21 days, 22 days, 23 days, 24 days, 25 days, 26 days, 27 days, 28 days, 29 days, 30 days, 1 week, 2 weeks, 3 weeks, 4 weeks, 1 month, 2 months, 3 months, 4 months, 5 months, 6 months, 7 months, 8 months, 9 months, 10 months, 11 months, 12 months, or any combination thereof, before the peptidomimetic macrocycle is administered.

Also, contemplated herein is a drug holiday utilized among the administration of a peptidomimetic macrocycle and an additional pharmaceutically-active agent, for example, any additional therapeutic agent described herein. A drug holiday can be a period of days after the administration of the additional pharmaceutically-active agent, for example, any additional therapeutic agent described herein, and before the administration of a peptidomimetic macrocycle. A drug holiday can be a period of days after the administration of a peptidomimetic macrocycle and before the administration of the additional pharmaceutically-active agent, for example, any additional therapeutic agent described herein. A drug holiday can be a period of days after the sequential administration of one or more of a peptidomimetic macrocycle and an additional pharmaceutically-active agent, for example, any additional therapeutic agent described herein, and before the administration of the peptidomimetic macrocycle, the additional pharmaceutically-active agent or another therapeutic agent. For example, a drug holiday can be a period of days after the sequential administration of a peptidomimetic macrocycle first, followed administration of an additional pharmaceutically-active agent, for example, any additional therapeutic agent described herein, and before the administration of the peptidomimetic macrocycle again. For example, a drug holiday can be a period of days after the sequential administration of an additional pharmaceutically-active agent first, followed administration of a peptidomimetic macrocycle and before the administration of the additional pharmaceutically-active agent, for example, any additional therapeutic agent described herein.

Suitably the drug holiday will be a period of 1 day, 2 days, 3 days, 4 days, 5 days, 6 days, 7 days, 8 days, 9 days, 10 days, 11 days, 12 days, 13 days or 14 days; or from 1-24, 2-24, 3-24, 4-24, 5-24, 6-24, 7-24, 8-24, 9-24, 10-24, 11-24, or 12-24 hours; from 1-30, 2-30, 3-30, 4-30, 5-30, 6-30, 7-30, 8-30, 9-30, 10-30, 11-30, 12-30, 13-30, 14-30, 15-30, 16-30, 17-30, 18-30, 19-30, 20-30, 21-30, 22-30, 23-30, 24-30, 25-30, 26-30, 27-30, 28-30, or 29-30 days, 1-4, 2-4, or 3-4 weeks; or from 1-12, 2-12, 3-12, 4-12, 5-12, 6-12, 7-12, 8-12, 9-12, 10-12, or 11-12 months.

In some embodiments, an additional pharmaceutically-active agent, for example, any additional therapeutic agent described herein, will be administered first in the sequence, followed by an optional drug holiday, followed by administration of a peptidomimetic macrocycle. In some embodiments, an additional pharmaceutically-active agent, for example, any additional therapeutic agent described herein, will be administered first in the sequence, followed by administration of a peptidomimetic macrocycle, followed by an optional drug holiday, followed by administration of an additional pharmaceutically-active agent.

In some embodiments, an additional pharmaceutically-active agent, for example, any additional therapeutic agent described herein, is administered for from 1-24, 2-24, 3-24, 4-24, 5-24, 6-24, 7-24, 8-24, 9-24, 10-24, 11-24, or 12-24 consecutive hours; from 1-30, 2-30, 3-30, 4-30, 5-30, 6-30, 7-30, 8-30, 9-30, 10-30, 11-30, 12-30, 13-30, 14-30, 15-30, 16-30, 17-30, 18-30, 19-30, 20-30, 21-30, 22-30, 23-30, 24-30, 25-30, 26-30, 27-30, 28-30, or 29-30 consecutive days, 1-4, 2-4, or 3-4 consecutive weeks; or from 1-12, 2-12, 3-12, 4-12, 5-12, 6-12, 7-12, 8-12, 9-12, 10-12, or 11-12 consecutive months, followed by an optional drug holiday; followed by administration of a peptidomimetic macrocycle for from 1-24, 2-24, 3-24, 4-24, 5-24, 6-24, 7-24, 8-24, 9-24, 10-24, 11-24, or 12-24 consecutive hours; from 1-30, 2-30, 3-30, 4-30, 5-30, 6-30, 7-30, 8-30, 9-30, 10-30, 11-30, 12-30, 13-30, 14-30, 15-30, 16-30, 17-30, 18-30, 19-30, 20-30, 21-30, 22-30, 23-30, 24-30, 25-30, 26-30, 27-30, 28-30, or 29-30 consecutive days, 1-4, 2-4, or 3-4 consecutive weeks; or from 1-12, 2-12, 3-12, 4-12, 5-12, 6-12, 7-12, 8-12, 9-12, 10-12, or 11-12 consecutive months. For example, a cyclin dependent kinase inhibitor is administered for from 1-24, 2-24, 3-24, 4-24, 5-24, 6-24, 7-24, 8-24, 9-24, 10-24, 11-24, or 12-24 consecutive hours; from 1-30, 2-30, 3-30, 4-30, 5-30, 6-30, 7-30, 8-30, 9-30, 10-30, 11-30, 12-30, 13-30, 14-30, 15-30, 16-30, 17-30, 18-30, 19-30, 20-30, 21-30, 22-30, 23-30, 24-30, 25-30, 26-30, 27-30, 28-30, or 29-30 consecutive days, 1-4, 2-4, or 3-4 consecutive weeks; or from 1-12, 2-12, 3-12, 4-12, 5-12, 6-12, 7-12, 8-12, 9-12, 10-12, or 11-12 consecutive months; followed by a drug holiday of from 1-24, 2-24, 3-24, 4-24, 5-24, 6-24, 7-24, 8-24, 9-24, 10-24, 11-24, or 12-24 consecutive hours; from 1-30, 2-30, 3-30, 4-30, 5-30, 6-30, 7-30, 8-30, 9-30, 10-30, 11-30, 12-30, 13-30, 14-30, 15-30, 16-30, 17-30, 18-30, 19-30, 20-30, 21-30, 22-30, 23-30, 24-30, 25-30, 26-30, 27-30, 28-30, or 29-30 consecutive days, 1-4, 2-4, or 3-4 consecutive weeks; or from 1-12, 2-12, 3-12, 4-12, 5-12, 6-12, 7-12, 8-12, 9-12, 10-12, or 11-12 consecutive months; followed by administration of a peptidomimetic macrocycle for from 1-24, 2-24, 3-24, 4-24, 5-24, 6-24, 7-24, 8-24, 9-24, 10-24, 11-24, or 12-24 consecutive hours; from 1-30, 2-30, 3-30, 4-30, 5-30, 6-30, 7-30, 8-30, 9-30, 10-30, 11-30, 12-30, 13-30, 14-30, 15-30, 16-30, 17-30, 18-30, 19-30, 20-30, 21-30, 22-30, 23-30, 24-30, 25-30, 26-30, 27-30, 28-30, or 29-30 consecutive days, 1-4, 2-4, or 3-4 consecutive weeks; or from 1-12, 2-12, 3-12, 4-12, 5-12, 6-12, 7-12, 8-12, 9-12, 10-12, or 11-12 consecutive months.

In some embodiments, an additional pharmaceutically-active agent, for example, any additional therapeutic agent described herein, is administered for from 1-24, 2-24, 3-24, 4-24, 5-24, 6-24, 7-24, 8-24, 9-24, 10-24, 11-24, or 12-24 consecutive hours; from 1-30, 2-30, 3-30, 4-30, 5-30, 6-30, 7-30, 8-30, 9-30, 10-30, 11-30, 12-30, 13-30, 14-30, 15-30, 16-30, 17-30, 18-30, 19-30, 20-30, 21-30, 22-30, 23-30, 24-30, 25-30, 26-30, 27-30, 28-30, or 29-30 consecutive days, 1-4, 2-4, or 3-4 consecutive weeks; or from 1-12, 2-12, 3-12, 4-12, 5-12, 6-12, 7-12, 8-12, 9-12, 10-12, or 11-12 consecutive months, followed by administration of a peptidomimetic macrocycle for from 1-24, 2-24, 3-24, 4-24, 5-24, 6-24, 7-24, 8-24, 9-24, 10-24, 11-24, or 12-24 consecutive hours; from 1-30, 2-30, 3-30, 4-30, 5-30, 6-30, 7-30, 8-30, 9-30, 10-30, 11-30, 12-30, 13-30, 14-30, 15-30, 16-30, 17-30, 18-30, 19-30, 20-30, 21-30, 22-30, 23-30, 24-30, 25-30, 26-30, 27-30, 28-30, or 29-30 consecutive days, 1-4, 2-4, or 3-4 consecutive weeks; or from 1-12, 2-12, 3-12, 4-12, 5-12, 6-12, 7-12, 8-12, 9-12, 10-12, or 11-12 consecutive months, followed by an optional drug holiday; followed by administration of an additional pharmaceutically-active agent. For example, a cyclin dependent kinase inhibitor is administered for from 1-24, 2-24, 3-24, 4-24, 5-24, 6-24, 7-24, 8-24, 9-24, 10-24, 11-24, or 12-24 consecutive hours; from 1-30, 2-30, 3-30, 4-30, 5-30, 6-30, 7-30, 8-30, 9-30, 10-30, 11-30, 12-30, 13-30, 14-30, 15-30, 16-30, 17-30, 18-30, 19-30, 20-30, 21-30, 22-30, 23-30, 24-30, 25-30, 26-30, 27-30, 28-30, or 29-30 consecutive days, 1-4, 2-4, or 3-4 consecutive weeks; or from 1-12, 2-12, 3-12, 4-12, 5-12, 6-12, 7-12, 8-12, 9-12, 10-12, or 11-12 consecutive months; followed by administration of a peptidomimetic macrocycle for from 1-24, 2-24, 3-24, 4-24, 5-24, 6-24, 7-24, 8-24, 9-24, 10-24, 11-24, or 12-24 consecutive hours; from 1-30, 2-30, 3-30, 4-30, 5-30, 6-30, 7-30, 8-30, 9-30, 10-30, 11-30, 12-30, 13-30, 14-30, 15-30, 16-30, 17-30, 18-30, 19-30, 20-30, 21-30, 22-30, 23-30, 24-30, 25-30, 26-30, 27-30, 28-30, or 29-30 consecutive days, 1-4, 2-4, or 3-4 consecutive weeks; or from 1-12, 2-12, 3-12, 4-12, 5-12, 6-12, 7-12, 8-12, 9-12, 10-12, or 11-12 consecutive months, followed by an optional drug holiday of from 1-24, 2-24, 3-24, 4-24, 5-24, 6-24, 7-24, 8-24, 9-24, 10-24, 11-24, or 12-24 consecutive hours; from 1-30, 2-30, 3-30, 4-30, 5-30, 6-30, 7-30, 8-30, 9-30, 10-30, 11-30, 12-30, 13-30, 14-30, 15-30, 16-30, 17-30, 18-30, 19-30, 20-30, 21-30, 22-30, 23-30, 24-30, 25-30, 26-30, 27-30, 28-30, or 29-30 consecutive days, 1-4, 2-4, or 3-4 consecutive weeks; or from 1-12, 2-12, 3-12, 4-12, 5-12, 6-12, 7-12, 8-12, 9-12, 10-12, or 11-12 consecutive months; followed by administration of a cyclin dependent kinase inhibitor.

In some embodiments, a peptidomimetic macrocycle will be administered first in the sequence, followed by an optional drug holiday, followed by administration of an additional pharmaceutically-active agent, for example, any additional therapeutic agent described herein. In some embodiments, a peptidomimetic macrocycle will be administered first in the sequence, followed by administration of an additional pharmaceutically-active agent, for example, any additional therapeutic agent described herein, followed by an optional drug holiday, followed by administration of a peptidomimetic macrocycle.

In some embodiments, a peptidomimetic macrocycle is administered for from 1-24, 2-24, 3-24, 4-24, 5-24, 6-24, 7-24, 8-24, 9-24, 10-24, 11-24, or 12-24 consecutive hours; from 1-30, 2-30, 3-30, 4-30, 5-30, 6-30, 7-30, 8-30, 9-30, 10-30, 11-30, 12-30, 13-30, 14-30, 15-30, 16-30, 17-30, 18-30, 19-30, 20-30, 21-30, 22-30, 23-30, 24-30, 25-30, 26-30, 27-30, 28-30, or 29-30 consecutive days, 1-4, 2-4, or 3-4 consecutive weeks; or from 1-12, 2-12, 3-12, 4-12, 5-12, 6-12, 7-12, 8-12, 9-12, 10-12, or 11-12 consecutive months, followed by an optional drug holiday; followed by administration of an additional pharmaceutically-active agent, for example, any additional therapeutic agent described herein, for from 1-24, 2-24, 3-24, 4-24, 5-24, 6-24, 7-24, 8-24, 9-24, 10-24, 11-24, or 12-24 consecutive hours; from 1-30, 2-30, 3-30, 4-30, 5-30, 6-30, 7-30, 8-30, 9-30, 10-30, 11-30, 12-30, 13-30, 14-30, 15-30, 16-30, 17-30, 18-30, 19-30, 20-30, 21-30, 22-30, 23-30, 24-30, 25-30, 26-30, 27-30, 28-30, or 29-30 consecutive days, 1-4, 2-4, or 3-4 consecutive weeks; or from 1-12, 2-12, 3-12, 4-12, 5-12, 6-12, 7-12, 8-12, 9-12, 10-12, or 11-12 consecutive months. For example, a peptidomimetic macrocycle is administered for from 1-24, 2-24, 3-24, 4-24, 5-24, 6-24, 7-24, 8-24, 9-24, 10-24, 11-24, or 12-24 consecutive hours; from 1-30, 2-30, 3-30, 4-30, 5-30, 6-30, 7-30, 8-30, 9-30, 10-30, 11-30, 12-30, 13-30, 14-30, 15-30, 16-30, 17-30, 18-30, 19-30, 20-30, 21-30, 22-30, 23-30, 24-30, 25-30, 26-30, 27-30, 28-30, or 29-30 consecutive days, 1-4, 2-4, or 3-4 consecutive weeks; or from 1-12, 2-12, 3-12, 4-12, 5-12, 6-12, 7-12, 8-12, 9-12, 10-12, or 11-12 consecutive months; followed by a drug holiday of from 1-24, 2-24, 3-24, 4-24, 5-24, 6-24, 7-24, 8-24, 9-24, 10-24, 11-24, or 12-24 consecutive hours; from 1-30, 2-30, 3-30, 4-30, 5-30, 6-30, 7-30, 8-30, 9-30, 10-30, 11-30, 12-30, 13-30, 14-30, 15-30, 16-30, 17-30, 18-30, 19-30, 20-30, 21-30, 22-30, 23-30, 24-30, 25-30, 26-30, 27-30, 28-30, or 29-30 consecutive days, 1-4, 2-4, or 3-4 consecutive weeks; or from 1-12, 2-12, 3-12, 4-12, 5-12, 6-12, 7-12, 8-12, 9-12, 10-12, or 11-12 consecutive months; followed by administration of a cyclin dependent kinase inhibitor for from 1-24, 2-24, 3-24, 4-24, 5-24, 6-24, 7-24, 8-24, 9-24, 10-24, 11-24, or 12-24 consecutive hours; from 1-30, 2-30, 3-30, 4-30, 5-30, 6-30, 7-30, 8-30, 9-30, 10-30, 11-30, 12-30, 13-30, 14-30, 15-30, 16-30, 17-30, 18-30, 19-30, 20-30, 21-30, 22-30, 23-30, 24-30, 25-30, 26-30, 27-30, 28-30, or 29-30 consecutive days, 1-4, 2-4, or 3-4 consecutive weeks; or from 1-12, 2-12, 3-12, 4-12, 5-12, 6-12, 7-12, 8-12, 9-12, 10-12, or 11-12 consecutive months In some embodiments, a peptidomimetic macrocycle is administered for from 1-24, 2-24, 3-24, 4-24, 5-24, 6-24, 7-24, 8-24, 9-24, 10-24, 11-24, or 12-24 consecutive hours; from 1-30, 2-30, 3-30, 4-30, 5-30, 6-30, 7-30, 8-30, 9-30, 10-30, 11-30, 12-30, 13-30, 14-30, 15-30, 16-30, 17-30, 18-30, 19-30, 20-30, 21-30, 22-30, 23-30, 24-30, 25-30, 26-30, 27-30, 28-30, or 29-30 consecutive days, 1-4, 2-4, or 3-4 consecutive weeks; or from 1-12, 2-12, 3-12, 4-12, 5-12, 6-12, 7-12, 8-12, 9-12, 10-12, or 11-12 consecutive months, followed by administration of an additional pharmaceutically-active agent, for example, any additional therapeutic agent described herein, for from 1-24, 2-24, 3-24, 4-24, 5-24, 6-24, 7-24, 8-24, 9-24, 10-24, 11-24, or 12-24 consecutive hours; from 1-30, 2-30, 3-30, 4-30, 5-30, 6-30, 7-30, 8-30, 9-30, 10-30, 11-30, 12-30, 13-30, 14-30, 15-30, 16-30, 17-30, 18-30, 19-30, 20-30, 21-30, 22-30, 23-30, 24-30, 25-30, 26-30, 27-30, 28-30, or 29-30 consecutive days, 1-4, 2-4, or 3-4 consecutive weeks; or from 1-12, 2-12, 3-12, 4-12, 5-12, 6-12, 7-12, 8-12, 9-12, 10-12, or 11-12 consecutive months, followed by an optional drug holiday; followed by administration of a peptidomimetic macrocycle. For example, a peptidomimetic macrocycle is administered for from 1-24, 2-24, 3-24, 4-24, 5-24, 6-24, 7-24, 8-24, 9-24, 10-24, 11-24, or 12-24 consecutive hours; from 1-30, 2-30, 3-30, 4-30, 5-30, 6-30, 7-30, 8-30, 9-30, 10-30, 11-30, 12-30, 13-30, 14-30, 15-30, 16-30, 17-30, 18-30, 19-30, 20-30, 21-30, 22-30, 23-30, 24-30, 25-30, 26-30, 27-30, 28-30, or 29-30 consecutive days, 1-4, 2-4, or 3-4 consecutive weeks; or from 1-12, 2-12, 3-12, 4-12, 5-12, 6-12, 7-12, 8-12, 9-12, 10-12, or 11-12 consecutive months; followed by administration of a cyclin dependent kinase inhibitor for from 1-24, 2-24, 3-24, 4-24, 5-24, 6-24, 7-24, 8-24, 9-24, 10-24, 11-24, or 12-24 consecutive hours; from 1-30, 2-30, 3-30, 4-30, 5-30, 6-30, 7-30, 8-30, 9-30, 10-30, 11-30, 12-30, 13-30, 14-30, 15-30, 16-30, 17-30, 18-30, 19-30, 20-30, 21-30, 22-30, 23-30, 24-30, 25-30, 26-30, 27-30, 28-30, or 29-30 consecutive days, 1-4, 2-4, or 3-4 consecutive weeks; or from 1-12, 2-12, 3-12, 4-12, 5-12, 6-12, 7-12, 8-12, 9-12, 10-12, or 11-12 consecutive months, followed by an optional drug holiday of from 1-24, 2-24, 3-24, 4-24, 5-24, 6-24, 7-24, 8-24, 9-24, 10-24, 11-24, or 12-24 consecutive hours; from 1-30, 2-30, 3-30, 4-30, 5-30, 6-30, 7-30, 8-30, 9-30, 10-30, 11-30, 12-30, 13-30, 14-30, 15-30, 16-30, 17-30, 18-30, 19-30, 20-30, 21-30, 22-30, 23-30, 24-30, 25-30, 26-30, 27-30, 28-30, or 29-30 consecutive days, 1-4, 2-4, or 3-4 consecutive weeks; or from 1-12, 2-12, 3-12, 4-12, 5-12, 6-12, 7-12, 8-12, 9-12, 10-12, or 11-12 consecutive months; followed by administration of a peptidomimetic macrocycle.

In some embodiments, an additional pharmaceutically-active agent, for example, any additional therapeutic agent described herein, will be administered first in the sequence, followed by an optional drug holiday, followed by administration of a peptidomimetic macrocycle. In some embodiments, a cyclin dependent kinase inhibitor will be administered first in the sequence, followed by an optional drug holiday, followed by administration of a peptidomimetic macrocycle, followed by an optional drug holiday, followed by administration of a cyclin dependent kinase inhibitor.

In some embodiments, an additional pharmaceutically-active agent, for example, any additional therapeutic agent described herein, is administered for from 1 to 30 consecutive days, followed by an optional drug holiday, followed by administration of peptidomimetic macrocycle for from 1 to 30 consecutive days. In some embodiments, an additional pharmaceutically-active agent, for example, any additional therapeutic agent described herein, is administered for from 1 to 21 consecutive days, followed by an optional drug holiday, followed by administration of a peptidomimetic macrocycle for from 1 to 21 consecutive days. In some embodiments, an additional pharmaceutically-active agent, for example, any additional therapeutic agent described herein, is administered for from 1 to 14 consecutive days, followed by an optional drug holiday, followed by administration of a peptidomimetic macrocycle for from 1 to 14 consecutive days. In some embodiments, an additional pharmaceutically-active agent, for example, any additional therapeutic agent described herein, is administered for 14 consecutive days, followed by an optional drug holiday, followed by administration of a peptidomimetic macrocycle for 7 consecutive days. In some embodiments, an additional pharmaceutically-active agent, for example, any additional therapeutic agent described herein, is administered for 7 consecutive days, followed by an optional drug holiday, followed by administration of a peptidomimetic macrocycle for 7 consecutive days.

In some embodiments, a peptidomimetic macrocycle is administered for from 1 to 30 consecutive days, followed by an optional drug holiday, followed by administration of an additional pharmaceutically-active agent, for example, any additional therapeutic agent described herein, for from 1 to 30 consecutive days. In some embodiments, a peptidomimetic macrocycle is administered for from 1 to 21 consecutive days, followed by an optional drug holiday, followed by administration of an additional pharmaceutically-active agent, for example, any additional therapeutic agent described herein, for from 1 to 21 consecutive days. In some embodiments, a peptidomimetic macrocycle is administered for from 1 to 14 consecutive days, followed by an optional drug holiday, followed by administration of an additional pharmaceutically-active agent, for example, any additional therapeutic agent described herein, for from 1 to 14 consecutive days. In some embodiments, a peptidomimetic macrocycle is administered for 14 consecutive days, followed by an optional drug holiday, followed by administration of an additional pharmaceutically-active agent, for example, any additional therapeutic agent described herein, for 14 consecutive days. In some embodiments, a peptidomimetic macrocycle is administered for 7 consecutive days, followed by an optional drug holiday, followed by administration of an additional pharmaceutically-active agent, for example, any additional therapeutic agent described herein, for 7 consecutive days.

In some embodiments, one of a peptidomimetic macrocycle and an additional pharmaceutically-active agent, for example, any additional therapeutic agent described herein, is administered for from 2 to 30 consecutive days, followed by an optional drug holiday, followed by administration of the other of a peptidomimetic macrocycle and an additional pharmaceutically-active agent for from 2 to 30 consecutive days. In some embodiments, one of a peptidomimetic macrocycle and an additional pharmaceutically-active agent, for example, any additional therapeutic agent described herein, is administered for from 2 to 21 consecutive days, followed by an optional drug holiday, followed by administration of the other of a peptidomimetic macrocycle and an additional pharmaceutically-active agent for from 2 to 21 consecutive days. In some embodiments, one of a peptidomimetic macrocycle and an additional pharmaceutically-active agent, for example, any additional therapeutic agent described herein, is administered for from 2 to 14 consecutive days, followed by a drug holiday of from 1 to 14 days, followed by administration of the other of a peptidomimetic macrocycle and an additional pharmaceutically-active agent for from 2 to 14 consecutive days. In some embodiments, one of a peptidomimetic macrocycle and an additional pharmaceutically-active agent, for example, any additional therapeutic agent described herein, is administered for from 3 to 7 consecutive days, followed by a drug holiday of from 3 to 10 days, followed by administration of the other of a peptidomimetic macrocycle and an additional pharmaceutically-active agent for from 3 to 7 consecutive days.

In some embodiments, a cyclin dependent kinase inhibitor will be administered first in the sequence, followed by an optional drug holiday, followed by administration of a peptidomimetic macrocycle. In some embodiments, a cyclin dependent kinase inhibitor is administered for from 3 to 21 consecutive days, followed by an optional drug holiday, followed by administration of a peptidomimetic macrocycle for from 3 to 21 consecutive days. In some embodiments, a cyclin dependent kinase inhibitor is administered for from 3 to 21 consecutive days, followed by a drug holiday of from 1 to 14 days, followed by administration of a peptidomimetic macrocycle for from 3 to 21 consecutive days. In some embodiments, a cyclin dependent kinase inhibitor is administered for from 3 to 21 consecutive days, followed by a drug holiday of from 3 to 14 days, followed by administration of a peptidomimetic macrocycle for from 3 to 21 consecutive days. In some embodiments, a cyclin dependent kinase inhibitor is administered for 21 consecutive days, followed by an optional drug holiday, followed by administration of a peptidomimetic macrocycle for 14 consecutive days. In some embodiments, a cyclin dependent kinase inhibitor is administered for 14 consecutive days, followed by a drug holiday of from 1 to 14 days, followed by administration of a peptidomimetic macrocycle for 14 consecutive days. In some embodiments, a cyclin dependent kinase inhibitor is administered for 7 consecutive days, followed by a drug holiday of from 3 to 10 days, followed by administration of a peptidomimetic macrocycle for 7 consecutive days. In some embodiments, a cyclin dependent kinase inhibitor is administered for 3 consecutive days, followed by a drug holiday of from 3 to 14 days, followed by administration of a peptidomimetic macrocycle for 7 consecutive days. In some embodiments, a cyclin dependent kinase inhibitor is administered for 3 consecutive days, followed by a drug holiday of from 3 to 10 days, followed by administration of a peptidomimetic macrocycle for 3 consecutive days.

In some embodiments, a peptidomimetic macrocycle will be administered first in the sequence, followed by an optional drug holiday, followed by administration of a cyclin dependent kinase inhibitor. In some embodiments, a peptidomimetic macrocycle is administered for from 3 to 21 consecutive days, followed by an optional drug holiday, followed by administration of a cyclin dependent kinase inhibitor for from 3 to 21 consecutive days. In some embodiments, a peptidomimetic macrocycle is administered for from 3 to 21 consecutive days, followed by a drug holiday of from 1 to 14 days, followed by administration of a cyclin dependent kinase inhibitor for from 3 to 21 consecutive days. In some embodiments, a peptidomimetic macrocycle is administered for from 3 to 21 consecutive days, followed by a drug holiday of from 3 to 14 days, followed by administration of a cyclin dependent kinase inhibitor for from 3 to 21 consecutive days. In some embodiments, a peptidomimetic macrocycle is administered for 21 consecutive days, followed by an optional drug holiday, followed by administration of a cyclin dependent kinase inhibitor for 14 consecutive days. In some embodiments, a peptidomimetic macrocycle s administered for 14 consecutive days, followed by a drug holiday of from 1 to 14 days, followed by administration of a cyclin dependent kinase inhibitor for 14 consecutive days. In some embodiments, a peptidomimetic macrocycle is administered for 7 consecutive days, followed by a drug holiday of from 3 to 10 days, followed by administration of a cyclin dependent kinase inhibitor for 7 consecutive days. In some embodiments, a peptidomimetic macrocycle is administered for 3 consecutive days, followed by a drug holiday of from 3 to 14 days, followed by administration of a cyclin dependent kinase inhibitor for 7 consecutive days. In some embodiments, a peptidomimetic macrocycle is administered for 3 consecutive days, followed by a drug holiday of from 3 to 10 days, followed by administration of a cyclin dependent kinase inhibitor for 3 consecutive days.

In some embodiments, a peptidomimetic macrocycle is administered once, twice, or thrice daily for 2, 3, 4, 5, 6, 7, 8, 9, 10, 11, 12, 13, 14, 15, 16, 17, 18, 19, 20, 21, 22, 23, 24, 25, 26, 27, 28, 29, or 30, consecutive days followed by 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 days of rest (e.g., no administration of the peptidomimetic macrocycle/discontinuation of treatment) in a 1, 2, 3, 4, 5, 6, 7, 8, 9, 10, 11, 12, 13, 14, 15, 16, 17, 18, 19, 20, 21, 22, 23, 24, 25, 26, 27, or 28 day cycle; and the additional pharmaceutically-active agent, for example, any additional therapeutic agent described herein, is administered prior to, concomitantly with, or subsequent to administration of the peptidomimetic macrocycle on one or more days (e.g., on day 1 of cycle 1). In some embodiments, the combination therapy is administered for 1, 2, 3, 4, 5, 6, 7, 8, 9, 10, 12, or 13 cycles of 1, 2, 3, 4, 5, 6, 7, 8, 9, 10, 11, 12, 13, 14, 15, 16, 17, 18, 19, 20, 21, 22, 23, 24, 25, 26, 27, or 28 days. In some embodiments, the combination therapy is administered for 1 to 12 or 13 cycles of 28 days (e.g., about 12 months).

In some embodiments, provided herein is a method of treating a condition or disease comprising administering to a patient in need thereof a therapeutically effective amount of a peptidomimetic macrocycle in combination with a therapeutically effective amount of an additional pharmaceutically-active agent, for example, any additional therapeutic agent described herein, and a secondary active agent, such as a checkpoint inhibitor. In some embodiments, a peptidomimetic macrocycle is administered once, twice, or thrice daily for 2, 3, 4, 5, 6, 7, 8, 9, 10, 11, 12, 13, 14, 15, 16, 17, 18, 19, 20, 21, 22, 23, 24, 25, 26, 27, 28, 29, or 30, consecutive days followed by 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 days of rest (e.g., no administration of the peptidomimetic macrocycle/discontinuation of treatment) in a 1, 2, 3, 4, 5, 6, 7, 8, 9, 10, 11, 12, 13, 14, 15, 16, 17, 18, 19, 20, 21, 22, 23, 24, 25, 26, 27, or 28 day cycle; the additional pharmaceutically-active agent, for example, any additional therapeutic agent described herein, is administered prior to, concomitantly with, or subsequent to administration of the peptidomimetic macrocycle on one or more days (e.g., on day 1 of cycle 1), and the secondary agent is administered daily, weekly, or monthly. In some embodiments, the combination therapy is administered for 1, 2, 3, 4, 5, 6, 7, 8, 9, 10, 12, or 13 cycles of 1, 2, 3, 4, 5, 6, 7, 8, 9, 10, 11, 12, 13, 14, 15, 16, 17, 18, 19, 20, 21, 22, 23, 24, 25, 26, 27, or 28 days. In some embodiments, the combination therapy is administered for 1 to 12 or 13 cycles of 28 days (e.g., about 12 months).

In some embodiments, administration of a combination therapy as described herein modulates expression levels of at least one checkpoint protein (e.g., PD-L1). Thus, provided herein are methods of determining the expression of at least of checkpoint proteins, where the determination of the expression level is performed before, during, and/or after administration of a combination therapy described herein. The checkpoint protein expression levels determined before, during, and/or after administration of a combination therapy as described herein can be compared against each other or standard controls. Such comparisons can translate into determination of the efficacy of the administered treatment where in one embodiment a level of decreased expression of a given checkpoint protein indicates a greater effectiveness of the combination therapy. In some embodiments, treatment using the combination therapies described herein can be monitored or determined using assays to determine expression levels of checkpoint proteins (e.g., PD-L1, TIM-3, LAG-3, CTLA-4, OX40, Treg, CD25, CD127, FoxP3). Determining the expression of such checkpoint proteins can be performed before, during, or after completion of treatment with a combination therapy described herein. Expression can be determined using techniques known in the art, including for example flow-cytometry.

In some embodiments, the components of the combination therapies described herein (e.g., a peptidomimetic macrocycle and a cyclin dependent kinase inhibitor) are cyclically administered to a patient. In some embodiments, a secondary active agent is co-administered in a cyclic administration with the combination therapies provided herein. Cycling therapy involves the administration of an active agent for a period of time, followed by a rest for a period of time, and repeating this sequential administration. Cycling therapy can be performed independently for each active agent (e.g., a peptidomimetic macrocycle and a cyclin dependent kinase inhibitor, and/or a secondary agent) over a prescribed duration of time. In some embodiments, the cyclic administration of each active agent is dependent upon one or more of the active agents administered to the subject. In some embodiments, administration of a peptidomimetic macrocycle or a cyclin dependent kinase inhibitor fixes the day(s) or duration of administration of each agent. In some embodiments, administration of a peptidomimetic macrocycle or a cyclin dependent kinase inhibitor fixes the days(s) or duration of administration of a secondary active agent.

In some embodiments, a peptidomimetic macrocycle, a cyclin dependent kinase inhibitor, and/or a secondary active agent is administered continually (e.g., daily, weekly, monthly) without a rest period. Cycling therapy can reduce the development of resistance to one or more of the therapies, avoid, or reduce the side effects of one of the therapies, and/or improve the efficacy of the treatment or therapeutic agent.

In some embodiments, the frequency of administration is in the range of about a daily dose to about a monthly dose. In some embodiments, administration is once a day, twice a day, three times a day, four times a day, once every other day, twice a week, once every week, once every two weeks, once every three weeks, or once every four weeks. In some embodiments, a compound for use in combination therapies described herein is administered once a day. In some embodiments, a compound for use in combination therapies described herein is administered twice a day. In some embodiments, a compound for use in combination therapies described herein is administered three times a day. In some embodiments, a compound for use in combination therapies described herein is administered four times a day.

In some embodiments, the frequency of administration of a peptidomimetic macrocycle is in the range of about a daily dose to about a monthly dose. In some embodiments, administration of a peptidomimetic macrocycle is once a day, twice a day, three times a day, four times a day, once every other day, twice a week, once every week, once every two weeks, once every three weeks, or once every four weeks. In some embodiments, a peptidomimetic macrocycle for use in combination therapies described herein is administered once a day. In some embodiments, a peptidomimetic macrocycle for use in combination therapies described herein is administered twice a day. In some embodiments, a peptidomimetic macrocycle for use in combination therapies described herein is administered three times a day. In some embodiments, a peptidomimetic macrocycle for use in combination therapies described herein is administered four times a day.

In some embodiments, the frequency of administration of an additional pharmaceutically-active agent, for example, any additional therapeutic agent described herein, is in the range of about a daily dose to about a monthly dose. In some embodiments, administration of an additional pharmaceutically-active agent, for example, any additional therapeutic agent described herein, is once a day, twice a day, three times a day, four times a day, once every other day, twice a week, once every week, once every two weeks, once every three weeks, or once every four weeks. In some embodiments, an additional pharmaceutically-active agent, for example, any additional therapeutic agent described herein, for use in combination therapies described herein is administered once a day. In some embodiments, an additional pharmaceutically-active agent, for example, any additional therapeutic agent described herein, for use in combination therapies described herein is administered twice a day. In some embodiments, an additional pharmaceutically-active agent, for example, any additional therapeutic agent described herein, for use in combination therapies described herein is administered three times a day. In some embodiments, an additional pharmaceutically-active agent, for example, any additional therapeutic agent described herein, for use in combination therapies described herein is administered four times a day.

In some embodiments, a compound for use in combination therapies described herein is administered once per day from one day to six months, from one week to three months, from one week to four weeks, from one week to three weeks, or from one week to two weeks. In some embodiments, a compound for use in combination therapies described herein is administered once per day for one week, two weeks, three weeks, or four weeks. In some embodiments, a compound for use in combination therapies described herein is administered once per day for one week. In some embodiments, a compound for use in combination therapies described herein is administered once per day for two weeks. In some embodiments, a compound for use in combination therapies described herein is administered once per day for three weeks. In some embodiments, a compound for use in combination therapies described herein is administered once per day for four weeks.

Therapeutic compositions may be administered 1, 2, 3, 4, 5, 6, 7, 8, 9, 10, 11, 12, 13, 14, 15, 16, 17, 18, 19, 20 or more times, and they may be administered every 1, 2, 3, 4, 5, 6, 7, 8, 9, 10, 11, 12, 13, 14, 15, 16, 17, 18, 19, 20, 21, 22, 23, 24 hours, or 1, 2, 3, 4, 5, 6, 7 days, or 1, 2, 3, 4, 5 weeks, or 1, 2, 3, 4, 5, 6, 7, 8, 9, 10, 11, 12 months.

In some embodiments, the periodic administration of a peptidomimetic macrocycle and/or the additional pharmaceutically-active agent, for example, any additional therapeutic agent described herein, is effected daily. In some embodiments, the periodic administration of a peptidomimetic macrocycle and/or the additional pharmaceutically-active agent, for example, any additional therapeutic agent described herein, is effected twice daily at one half the amount.

In some embodiments, the periodic administration of a peptidomimetic macrocycle and/or the additional pharmaceutically-active agent, for example, any additional therapeutic agent described herein, is effected once every 3 to 11 days; or once every 5 to 9 days; or once every 7 days; or once every 24 hours. In some embodiments, the periodic administration of a peptidomimetic macrocycle and/or the additional pharmaceutically-active agent, for example, any additional therapeutic agent described herein, is effected once every 2 days, 3 days, 4 days, 5 days, 6 days, 7 days, 8 days, 9 days, 10 days, 11 days, 12 days, 13 days, 14 days, 15 days, 6 days, 16 days, 17 days, 18 days, 19 days, 20 days, 21 days, 22 days, 23 days, 24 days, 25 days, 26 days, 27 days, 28 days, 29 days, or 30 days.

In some embodiments, the periodic administration of a peptidomimetic macrocycle and/or additional pharmaceutically-active agent is effected one, twice, or thrice daily.

For each administration schedule of a peptidomimetic macrocycle, the periodic administration of the additional pharmaceutically-active agent, for example, any additional therapeutic agent described herein, may be effected once every 16-32 hours; or once every 18-30 hours; or once every 20-28 hours; or once every 22-26 hours. In some embodiments, the administration of a peptidomimetic macrocycle substantially precedes the additional pharmaceutically-active agent, for example, any additional therapeutic agent described herein. In some embodiments, the administration of the additional pharmaceutically-active agent, for example, any additional therapeutic agent described herein, substantially precedes the administration of a peptidomimetic macrocycle.

In some embodiments, a peptidomimetic macrocycle and the additional pharmaceutically-active agent, for example, any additional therapeutic agent described herein, may be administered for a period of time of at least 4 days. In some embodiments, the period of time may be 5 days to 5 years; or 10 days to 3 years; or 2 weeks to 1 year; or 1 month to 6 months; or 3 months to 4 months. In some embodiments, a peptidomimetic macrocycle and the additional pharmaceutically-active agent, for example, any additional therapeutic agent described herein, may be administered for the lifetime of the subject.

Administration of Combination Treatment in Controlled Studies

In some embodiments, a peptidimimetic macrocycle is administered in a controlled study to each mouse of a group of 5, 6, 7, 8, 9, 10, 11, 12, 13, 14, or 15 mice with a treatment regimen comprising: i) 20 mg per kilogram of body weight of the p53 activator administered once per week during a 22 day period; and ii) 75 mg per kilogram of body weight of the CDKI administered once per day during the 22 day period. In some embodiments, each mouse has a tumor such as an MCF-7 or SJSA tumor. In some embodiments median tumor growth in the group of mice occurs with at most a 10%, 20%, 30%, 40%, or 50% deviation from line 4 or line 5 shown in FIG. 32 or FIG. 33. In some embodiments, the CDKI is palbociclib.

In some embodiments, a peptidimimetic macrocycle is administered in a controlled study to each mouse of a group of 5, 6, 7, 8, 9, 10, 11, 12, 13, 14, or 15 mice with a treatment regimen comprising: i) 10 or 20 mg per kilogram of body weight of the p53 activator administered twice per week during a 22 day period; and ii) 75 mg per kilogram of body weight of the CDKI administered once per day during the 22 day period. In some embodiments, each mouse has a tumor such as an MCF-7 or SJSA tumor. In some embodiments median tumor growth in the group of mice occurs with at most a 10%, 20%, 30%, 40%, or 50% deviation from line 4 or line 5 shown in FIG. 34, FIG. 38, or FIG. 41. In some embodiments, the group of mice generates a survival curve with at most 10%, 20%, 30%, 40%, or 50% deviation from line 4 or line 5 shown in FIG. 35, FIG. 39, or FIG. 42. In some embodiments, the CDKI is palbociclib. In some embodiments, the CDKI is ribociclib.

In some embodiments, a peptidimimetic macrocycle is administered in a controlled study to each mouse of a group of 5, 6, 7, 8, 9, 10, 11, 12, 13, 14, or 15 mice with a treatment regimen comprising: i) 20 mg per kilogram of body weight of a p53 activator administered twice per week for a 22 day period; ii) 100 mg per kilogram of body weight of a CDKI administered once per day on days 1-14 of the 22 day period; and iii) 75 mg per kilogram of body weight of a CDKI administered once per day on days 18-22 of the 22 day period. In some embodiments, each mouse has a tumor such as an MCF-7 or SJSA tumor. In some embodiments median tumor growth in the group of mice occurs with at most a 10%, 20%, 30%, 40%, or 50% deviation from line 4 or line 5 shown in FIG. 36. In some embodiments, the group of mice generates a survival curve with at most 10%, 20%, 30%, 40%, or 50% deviation from line 4 or line 5 shown in FIG. 37. In some embodiments the CDKI is abemaciclib.

Pharmaceutical Compositions for Combination Treatment

According to certain embodiments, the peptidomimetic macrocycles and the additional pharmaceutically-active agent, for example, any additional therapeutic agent described herein, are administered within a single pharmaceutical composition. In some embodiments, the peptidomimetic macrocycles of the invention and the additional pharmaceutically-active agent, for example, any additional therapeutic agent described herein, can be provided in a single unit dosage form for being taken together. According to some embodiments, the pharmaceutical composition further comprises pharmaceutically-acceptable diluents or carrier. According to certain embodiments, the peptidomimetic macrocycles and the additional pharmaceutically-active agent, for example, any additional therapeutic agent described herein, are administered within different pharmaceutical composition. In some embodiments, the peptidomimetic macrocycles of the invention and the additional pharmaceutically-active agent, for example, any additional therapeutic agent described herein, can be provided in a single unit dosage as separate entities (e.g., in separate containers) to be administered simultaneously or with a certain time difference. In some embodiments, the peptidomimetic macrocycles of the disclosure and the additional pharmaceutically-active agent, for example, any additional therapeutic agent described herein, can be administered via the same route of administration. In some embodiments, the peptidomimetic macrocycles of the disclosure and the additional pharmaceutically-active agent, for example, any additional therapeutic agent described herein, can be administered via the different route of administration.

In some embodiments, the at least one additional pharmaceutical agent, for example, any additional therapeutic agent described herein, is administered at the therapeutic amount known to be used for treating the specific type of cancer. In some embodiments, the at least one additional pharmaceutical agent, for example, any additional therapeutic agent described herein, is administered in an amount lower than the therapeutic amount known to be used for treating the disease, i.e. a sub-therapeutic amount of the at least one additional pharmaceutical agent is administered.

A peptidomimetic macrocycle of the disclosure and at least one additional pharmaceutical agent, for example, any additional therapeutic agent described herein, administered to the subject can each be from about 0.01 mg/kg to about 100 mg/kg per body weight of the subject. In some embodiments, a peptidomimetic macrocycle of the disclosure and the at least one additional pharmaceutical agent, for example, any additional therapeutic agent described herein, administered to the subject can each be from about 0.01 mg/kg to about 1 mg/kg, 0.01 mg/kg to about 10 mg/kg, 0.01 mg/kg to about 100 mg/kg, 0.1 mg to about 1 mg/kg, 0.1 mg/kg to about 10 mg/kg, or 0.1 mg/kg to about 100 mg/kg per body weight of the subject. In some embodiments, the doses of a peptidomimetic macrocycle and additional therapeutic agent, for example, any additional therapeutic agent described herein, can be administered as a single dose or as multiple doses.

Sequence Homology

Two or more peptides can share a degree of homology. A pair of peptides can have, for example, up to about 20% pairwise homology, up to about 25% pairwise homology, up to about 30% pairwise homology, up to about 35% pairwise homology, up to about 40% pairwise homology, up to about 45% pairwise homology, up to about 50% pairwise homology, up to about 55% pairwise homology, up to about 60% pairwise homology, up to about 65% pairwise homology, up to about 70% pairwise homology, up to about 75% pairwise homology, up to about 80% pairwise homology, up to about 85% pairwise homology, up to about 90% pairwise homology, up to about 95% pairwise homology, up to about 96% pairwise homology, up to about 97% pairwise homology, up to about 98% pairwise homology, up to about 99% pairwise homology, up to about 99.5% pairwise homology, or up to about 99.9% pairwise homology. A pair of peptides can have, for example, at least about 20% pairwise homology, at least about 25% pairwise homology, at least about 30% pairwise homology, at least about 35% pairwise homology, at least about 40% pairwise homology, at least about 45% pairwise homology, at least about 50% pairwise homology, at least about 55% pairwise homology, at least about 60% pairwise homology, at least about 65% pairwise homology, at least about 70% pairwise homology, at least about 75% pairwise homology, at least about 80% pairwise homology, at least about 85% pairwise homology, at least about 90% pairwise homology, at least about 95% pairwise homology, at least about 96% pairwise homology, at least about 97% pairwise homology, at least about 98% pairwise homology, at least about 99% pairwise homology, at least about 99.5% pairwise homology, at least about 99.9% pairwise homology.

Various methods and software programs can be used to determine the homology between two or more peptides or nucleic acids, such as NCBI BLAST, Clustal W, MAFFT, Clustal Omega, AlignMe, Praline, or another suitable method or algorithm.

Methods of Detecting Wild Type p53 and/or p53 Mutations

In some embodiments, a subject lacking p53-deactivating mutations is a candidate for cancer treatment with a compound of the invention. Cancer cells from patient groups should be assayed in order to determine p53-deactivating mutations and/or expression of wild type p53 prior to treatment with a compound of the invention.

The activity of the p53 pathway can be determined by the mutational status of genes involved in the p53 pathways, including, for example, AKT1, AKT2, AKT3, ALK, BRAF, CDK4, CDKN2A, DDR2, EGFR, ERBB2 (HER2), FGFR1, FGFR3, GNA11, GNQ, GNAS, KDR, KIT, KRAS, MAP2K1 (MEK1), MET, HRAS, NOTCH1, NRAS, NTRK2, PIK3CA, NF1, PTEN, RAC1, RB1, NTRK3, STK11, PIK3R1, TSC1, TSC2, RET, TP53, and VHL. Genes that modulate the activity of p53 can also be assessed, including, for example, kinases: ABL1, JAK1, JAAK2, JAK3; receptor tyrosine kinases: FLT3 and KIT; receptors: CSF3R, IL7R, MPL, and NOTCH1; transcription factors: BCOR, CEBPA, CREBBP, ETV6, GATA1, GATA2. MLL, KZF1, PAX5, RUNX1, STAT3, WT1, and TP53; epigenetic factors: ASXL1, DNMT3A, EZH2, KDM6A (UTX), SUZ12, TET2, PTPN11, SF3B1, SRSF2, U2AF35, ZRSR2; RAS proteins: HRAS, KRAS, and NRAS; adaptors CBL and CBL-B; FBXW7, IDH1, IDH2, and NPM1.

Cancer cell samples can be obtained, for example, from solid or liquid tumors via primary or metastatic tumor resection (e.g. pneumonectomy, lobetomy, wedge resection, and craniotomy) primary or metastatic disease biopsy (e.g. transbronchial or needle core), pleural or ascites fluid (e.g. FFPE cell pellet), bone marrow aspirate, bone marrow clot, and bone marrow biopsy, or macro-dissection of tumor rich areas (solid tumors).

To detect the p53 wild type gene and/or lack of p53 deactivation mutation in a tissue, cancerous tissue can be isolated from surrounding normal tissues. For example, the tissue can be isolated from paraffin or cryostat sections. Cancer cells can also be separated from normal cells by flow cytometry. If the cancer cells tissue is highly contaminated with normal cells, detection of mutations can be more difficult.

Various methods and assays for analyzing wild type p53 and/or p53 mutations are suitable for use in the invention. Non-limiting examples of assays include polymerase chain reaction (PCR), restriction fragment length polymorphism (RFLP), microarray, Southern Blot, Northern Blot, Western Blot, Eastern Blot, HandE staining, microscopic assessment of tumors, next-generation DNA sequencing (NGS) (e.g. extraction, purification, quantification, and amplification of DNA, library preparation) immunohistochemistry, and fluorescent in situ hybridization (FISH).

A microarray allows a researcher to investigate multiple DNA sequences attached to a surface, for example, a DNA chip made of glass or silicon, or a polymeric bead or resin. The DNA sequences are hybridized with fluorescent or luminescent probes. The microarray can indicate the presence of oligonucleotide sequences in a sample based on hybridization of sample sequences to the probes, followed by washing and subsequent detection of the probes. Quantification of the fluorescent or luminescent signal indicates the presence of known oligonucleotide sequences in the sample.

PCR allows amplification of DNA oligomers rapidly, and can be used to identify an oligonucleotide sequence in a sample. PCR experiments involve contacting an oligonucleotide sample with a PCR mixture containing primers complementary to a target sequence, one or more DNA polymerase enzymes, deoxnucleotide triphosphate (dNTP) building blocks, including dATP, dGTP, dTTP, and dCTP, and suitable buffers, salts, and additives. If a sample contains an oligonucleotide sequence complementary to a pair of primers, the experiment amplifies the sample sequence, which can be collected and identified.

In some embodiments, an assay comprises amplifying a biomolecule from the cancer sample. The biomolecule can be a nucleic acid molecule, such as DNA or RNA. In some embodiments, the assay comprises circularization of a nucleic acid molecule, followed by digestion of the circularized nucleic acid molecule.

In some embodiments, the assay comprises contacting an organism, or a biochemical sample collected from an organism, such as a nucleic acid sample, with a library of oligonucleotides, such as PCR primers. The library can contain any number of oligonucleotide molecules. The oligonucleotide molecules can bind individual DNA or RNA motifs, or any combination of motifs described herein. The motifs can be any distance apart, and the distance can be known or unknown. In some embodiments, two or more oligonucleotides in the same library bind motifs a known distance apart in a parent nucleic acid sequence. Binding of the primers to the parent sequence can take place based on the complementarity of the primers to the parent sequence. Binding can take place, for example, under annealing, or under stringent conditions.

In some embodiments, the results of an assay are used to design a new oligonucleotide sequence for future use. In some embodiments, the results of an assay are used to design a new oligonucleotide library for future use. In some embodiments, the results of an assay are used to revise, refine, or update an existing oligonucleotide library for future use. For example, an assay can reveal that a previously-undocumented nucleic acid sequence is associated with the presence of a target material. This information can be used to design or redesign nucleic acid molecules and libraries.

In some embodiments, one or more nucleic acid molecules in a library comprise a barcode tag. In some embodiments, one or more of the nucleic acid molecules in a library comprise type I or type II restriction sites suitable for circularization and cutting an amplified sample nucleic acid sequence. Such primers can be used to circularize a PCR product and cut the PCR product to provide a product nucleic acid sequence with a sequence that is organized differently from the nucleic acid sequence native to the sample organism.

After a PCR experiment, the presence of an amplified sequence can be verified. Non-limiting examples of methods for finding an amplified sequence include DNA sequencing, whole transcriptome shotgun sequencing (WTSS, or RNA-seq), mass spectrometry (MS), microarray, pyrosequencing, column purification analysis, polyacrylamide gel electrophoresis, and index tag sequencing of a PCR product generated from an index-tagged primer.

In some embodiments, more than one nucleic acid sequence in the sample organism is amplified. Non-limiting examples of methods of separating different nucleic acid sequences in a PCR product mixture include column purification, high performance liquid chromatography (HPLC), HPLC/MS, polyacrylamide gel electrophoresis, size exclusion chromatography.

The amplified nucleic acid molecules can be identified by sequencing. Nucleic acid sequencing can be done on automated instrumentation. Sequencing experiments can be done in parallel to analyze tens, hundreds, or thousands of sequences simultaneously. Non-limiting examples of sequencing techniques follow.

In pyrosequencing, DNA is amplified within a water droplet containing a single DNA template bound to a primer-coated bead in an oil solution. Nucleotides are added to a growing sequence, and the addition of each base is evidenced by visual light.

Ion semiconductor sequencing detects the addition of a nucleic acid residue as an electrical signal associated with a hydrogen ion liberated during synthesis. A reaction well containing a template is flooded with the four types of nucleotide building blocks, one at a time. The timing of the electrical signal identifies which building block was added, and identifies the corresponding residue in the template.

DNA nanoball uses rolling circle replication to amplify DNA into nanoballs. Unchained sequencing by ligation of the nanoballs reveals the DNA sequence.

In a reversible dyes approach, nucleic acid molecules are annealed to primers on a slide and amplified. Four types of fluorescent dye residues, each complementary to a native nucleobase, are added, the residue complementary to the next base in the nucleic acid sequence is added, and unincorporated dyes are rinsed from the slide. Four types of reversible terminator bases (RT-bases) are added, and non-incorporated nucleotides are washed away. Fluorescence indicates the addition of a dye residue, thus identifying the complementary base in the template sequence. The dye residue is chemically removed, and the cycle repeats.

Detection of point mutations can be accomplished by molecular cloning of the p53 allele(s) present in the cancer cell tissue and sequencing that allele(s). Alternatively, the polymerase chain reaction can be used to amplify p53 gene sequences directly from a genomic DNA preparation from the cancer cell tissue. The DNA sequence of the amplified sequences can then be determined. Specific deletions of p53 genes can also be detected. For example, restriction fragment length polymorphism (RFLP) probes for the p53 gene or surrounding marker genes can be used to score loss of a p53 allele.

Loss of wild type p53 genes can also be detected on the basis of the loss of a wild type expression product of the p53 gene. Such expression products include both the mRNA as well as the p53 protein product itself. Point mutations can be detected by sequencing the mRNA directly or via molecular cloning of cDNA made from the mRNA. The sequence of the cloned cDNA can be determined using DNA sequencing techniques. The cDNA can also be sequenced via the polymerase chain reaction (PCR).

Alternatively, mismatch detection can be used to detect point mutations in the p53 gene or the mRNA product. The method can involve the use of a labeled riboprobe that is complementary to the human wild type p53 gene. The riboprobe and either mRNA or DNA isolated from the cancer cell tissue are annealed (hybridized) together and subsequently digested with the enzyme RNase A which is able to detect some mismatches in a duplex RNA structure. If a mismatch is detected by RNase A, the enzyme cleaves at the site of the mismatch. Thus, when the annealed RNA preparation is separated on an electrophoretic gel matrix, if a mismatch has been detected and cleaved by RNase A, an RNA product is seen that is smaller than the full-length duplex RNA for the riboprobe and the p53 mRNA or DNA. The riboprobe need not be the full length of the p53 mRNA or gene but can be a segment of either. If the riboprobe comprises only a segment of the p53 mRNA or gene it will be desirable to use a number of these probes to screen the whole mRNA sequence for mismatches.

In similar fashion, DNA probes can be used to detect mismatches, through enzymatic or chemical cleavage. Alternatively, mismatches can be detected by shifts in the electrophoretic mobility of mismatched duplexes relative to matched duplexes. With either riboprobes or DNA probes, the cellular mRNA or DNA which might contain a mutation can be amplified using PCR before hybridization.

DNA sequences of the p53 gene from the cancer cell tissue which have been amplified by use of polymerase chain reaction can also be screened using allele-specific probes. These probes are nucleic acid oligomers, each of which contains a region of the p53 gene sequence harboring a known mutation. For example, one oligomer can be about 30 nucleotides in length, corresponding to a portion of the p53 gene sequence. At the position coding for the 175th codon of p53 gene the oligomer encodes an alanine, rather than the wild type codon valine. By use of a battery of such allele-specific probes, the PCR amplification products can be screened to identify the presence of a previously identified mutation in the p53 gene. Hybridization of allele-specific probes with amplified p53 sequences can be performed, for example, on a nylon filter. Hybridization to a particular probe indicates the presence of the same mutation in the cancer cell tissue as in the allele-specific probe.

The identification of p53 gene structural changes in cancer cells can be facilitated through the application of a diverse series of high resolution, high throughput microarray platforms. Essentially two types of array include those that carry PCR products from cloned nucleic acids (e.g. cDNA, BACs, cosmids) and those that use oligonucleotides. The methods can provide a way to survey genome wide DNA copy number abnormalities and expression levels to allow correlations between losses, gains and amplifications in cancer cells with genes that are over- and under-expressed in the same samples. The gene expression arrays that provide estimates of mRNA levels in cancer cells have given rise to exon-specific arrays that can identify both gene expression levels, alternative splicing events and mRNA processing alterations.

Oligonucleotide arrays can be used to interrogate single nucleotide polymorphisms (SNPs) throughout the genome for linkage and association studies and these have been adapted to quantify copy number abnormalities and loss of heterozygosity events. DNA sequencing arrays can allow resequencing of chromosome regions, exomes, and whole genomes.

SNP-based arrays or other gene arrays or chips can determine the presence of wild type p53 allele and the structure of mutations. A single nucleotide polymorphism (SNP), a variation at a single site in DNA, is the most frequent type of variation in the genome. For example, there are an estimated 5-10 million SNPs in the human genome. SNPs can be synonymous or nonsynonymous substitutions. Synonymous SNP substitutions do not result in a change of amino acid in the protein due to the degeneracy of the genetic code, but can affect function in other ways. For example, a seemingly silent mutation in a gene that codes for a membrane transport protein can slow down translation, allowing the peptide chain to misfold, and produce a less functional mutant membrane transport protein. Nonsynonymous SNP substitutions can be missense substitutions or nonsense substitutions. Missense substitutions occur when a single base change results in change in amino acid sequence of the protein and malfunction thereof leads to disease. Nonsense substitutions occur when a point mutation results in a premature stop codon, or a nonsense codon in the transcribed mRNA, which results in a truncated and usually, nonfunctional, protein product. As SNPs are highly conserved throughout evolution and within a population, the map of SNPs serves as an excellent genotypic marker for research. SNP array is a useful tool to study the whole genome.

In addition, SNP array can be used for studying the Loss Of Heterozygosity (LOH). LOH is a form of allelic imbalance that can result from the complete loss of an allele or from an increase in copy number of one allele relative to the other. While other chip-based methods (e.g., comparative genomic hybridization can detect only genomic gains or deletions), SNP array has the additional advantage of detecting copy number neutral LOH due to uniparental disomy (UPD). In UPD, one allele or whole chromosome from one parent are missing leading to reduplication of the other parental allele (uni-parental=from one parent, disomy=duplicated). In a disease setting this occurrence can be pathologic when the wild type allele (e.g., from the mother) is missing and instead two copies of the heterozygous allele (e.g., from the father) are present. This usage of SNP array has a huge potential in cancer diagnostics as LOH is a prominent characteristic of most human cancers. SNP array technology have shown that cancers (e.g. gastric cancer, liver cancer, etc.) and hematologic malignancies (ALL, MDS, CML etc) have a high rate of LOH due to genomic deletions or UPD and genomic gains. In the present disclosure, using high density SNP array to detect LOH allows identification of pattern of allelic imbalance to determine the presence of wild type p53 allele.

Mutations of wild type p53 genes can also be detected on the basis of the mutation of a wild type expression product of the p53 gene. Such expression products include both the mRNA as well as the p53 protein product itself. Point mutations can be detected by sequencing the mRNA directly or via molecular cloning of cDNA made from the mRNA. The sequence of the cloned cDNA can be determined using DNA sequencing techniques. The cDNA can also be sequenced via the polymerase chain reaction (PCR). A panel of monoclonal antibodies could be used in which each of the epitopes involved in p53 functions are represented by a monoclonal antibody. Loss or perturbation of binding of a monoclonal antibody in the panel can indicate mutational alteration of the p53 protein and thus of the p53 gene itself. Mutant p53 genes or gene products can also be detected in body samples, including, for example, serum, stool, urine, and sputum. The same techniques discussed above for detection of mutant p53 genes or gene products in tissues can be applied to other body samples.

Loss of wild type p53 genes can also be detected by screening for loss of wild type p53 protein function. Although all of the functions which the p53 protein undoubtedly possesses have yet to be elucidated, at least two specific functions are known. Protein p53 binds to the SV40 large T antigen as well as to the adenovirus E1B antigen. Loss of the ability of the p53 protein to bind to either or both of these antigens indicates a mutational alteration in the protein which reflects a mutational alteration of the gene itself. Alternatively, a panel of monoclonal antibodies could be used in which each of the epitopes involved in p53 functions are represented by a monoclonal antibody. Loss or perturbation of binding of a monoclonal antibody in the panel would indicate mutational alteration of the p53 protein and thus of the p53 gene itself. Any method for detecting an altered p53 protein can be used to detect loss of wild type p53 genes.

Assays

The properties of peptidomimetic macrocycles are assayed, for example, by using the methods described below. In some embodiments, a peptidomimetic macrocycle has improved biological properties relative to a corresponding polypeptide lacking the substituents described herein.

a. Assays to Determine α-Helicity

In solution, the secondary structure of polypeptides with α-helical domains will reach a dynamic equilibrium between random coil structures and α-helical structures, often expressed as a "percent helicity". Thus, for example, alpha-helical domains are predominantly random coils in solution, with α-helical content usually under 25%. Peptidomimetic macrocycles with optimized linkers, on the other hand, possess, for example, an alpha-helicity that is at least two-fold greater than that of a corresponding uncrosslinked polypeptide. In some embodiments, macrocycles will possess an alpha-helicity of greater than 50%. To assay the helicity of peptidomimetic macrocycles, the compounds are dissolved in an aqueous solution (e.g. 50 mM potassium phosphate solution at pH 7, or distilled $H_2O$, to concentrations of 25-50 μM). Circular dichroism (CD) spectra are obtained on a spectropolarimeter using standard measurement parameters (e.g. temperature, 20° C.; wavelength, 190-260 nm; step resolution, 0.5 nm; speed, 20 nm/sec; accumulations, 10; response, 1 sec; bandwidth, 1 nm; path length, 0.1 cm). The α-helical content of each peptide is calculated by dividing the mean residue ellipticity (e.g. [Φ]222obs) by the reported value for a model helical decapeptide.

b. Assay to Determine Melting Temperature (Tm)

A peptidomimetic macrocycle comprising a secondary structure such as an α-helix exhibits, for example, a higher melting temperature than a corresponding uncrosslinked polypeptide. Peptidomimetic macrocycles exhibit Tm of >60° C. representing a highly stable structure in aqueous solutions. To assay the effect of macrocycle formation on melting temperature, peptidomimetic macrocycles or unmodified peptides are dissolved in distilled H$_2$O (e.g. at a final concentration of 50 μM) and the Tm is determined by measuring the change in ellipticity over a temperature range (e.g. 4 to 95° C.) on a spectropolarimeter using standard parameters (e.g. wavelength 222 nm; step resolution, 0.5 nm; speed, 20 nm/sec; accumulations, 10; response, 1 sec; bandwidth, 1 nm; temperature increase rate: 1° C./min; path length, 0.1 cm).

c. Protease Resistance Assay

The amide bond of the peptide backbone is susceptible to hydrolysis by proteases, thereby rendering peptidic compounds vulnerable to rapid degradation in vivo. Peptide helix formation, however, buries the amide backbone and therefore can shield it from proteolytic cleavage. The peptidomimetic macrocycles can be subjected to in vitro trypsin proteolysis to assess for any change in degradation rate compared to a corresponding uncrosslinked polypeptide. For example, the peptidomimetic macrocycle and a corresponding uncrosslinked polypeptide are incubated with trypsin agarose and the reactions quenched at various time points by centrifugation and subsequent HPLC injection to quantitate the residual substrate by ultraviolet absorption at 280 nm. Briefly, the peptidomimetic macrocycle and peptidomimetic precursor (5 mcg) are incubated with trypsin agarose (S/E~125) for 0, 10, 20, 90, and 180 minutes. Reactions are quenched by tabletop centrifugation at high speed; remaining substrate in the isolated supernatant is quantified by HPLC-based peak detection at 280 nm. The proteolytic reaction displays first order kinetics and the rate constant, k, is determined from a plot of ln[S] versus time (k=−1×slope).

d. Ex Vivo Stability Assay

Peptidomimetic macrocycles with optimized linkers possess, for example, an ex vivo half-life that is at least two-fold greater than that of a corresponding uncrosslinked polypeptide, and possess an ex vivo half-life of 12 hours or more. For ex vivo serum stability studies, a variety of assays can be used. For example, a peptidomimetic macrocycle and a corresponding uncrosslinked polypeptide (2 mcg) are incubated with fresh mouse, rat and/or human serum (2 mL) at 37° C. for 0, 1, 2, 4, 8, and 24 hours. To determine the level of intact compound, the following procedure can be used: The samples are extracted by transferring 100 μL of sera to 2 ml centrifuge tubes followed by the addition of 10 μL of 50% formic acid and 500 μL acetonitrile and centrifugation at 14,000 RPM for 10 min at 4±2° C. The supernatants are then transferred to fresh 2 ml tubes and evaporated on Turbovap under N$_2$<10 psi, 37° C. The samples are reconstituted in 100 μL of 50:50 acetonitrile:water and submitted to LC-MS/MS analysis.

e. In Vitro Binding Assays

To assess the binding and affinity of peptidomimetic macrocycles and peptidomimetic precursors to acceptor proteins, a fluorescence polarization assay (FPA) is used, for example. The FPA technique measures the molecular orientation and mobility using polarized light and fluorescent tracer. When excited with polarized light, fluorescent tracers (e.g., FITC) attached to molecules with high apparent molecular weights (e.g. FITC-labeled peptides bound to a large protein) emit higher levels of polarized fluorescence due to their slower rates of rotation as compared to fluorescent tracers attached to smaller molecules (e.g. FITC-labeled peptides that are free in solution).

For example, fluoresceinated peptidomimetic macrocycles (25 nM) are incubated with the acceptor protein (25-1000 nM) in binding buffer (140 mM NaCl, 50 mM Tris-HCL, pH 7.4) for 30 minutes at room temperature. Binding activity is measured, for example, by fluorescence polarization on a luminescence spectrophotometer. Kd values can be determined by nonlinear regression analysis using, for example, GraphPad Prism software. A peptidomimetic macrocycle shows, In some embodiments, similar or lower Kd than a corresponding uncrosslinked polypeptide.

f. In Vitro Displacement Assays to Characterize Antagonists of Peptide-Protein Interactions To assess the binding and affinity of compounds that antagonize the interaction between a peptide and an acceptor protein, a fluorescence polarization assay (FPA) utilizing a fluoresceinated peptidomimetic macrocycle derived from a peptidomimetic precursor sequence is used, for example. The FPA technique measures the molecular orientation and mobility using polarized light and fluorescent tracer. When excited with polarized light, fluorescent tracers (e.g., FITC) attached to molecules with high apparent molecular weights (e.g. FITC-labeled peptides bound to a large protein) emit higher levels of polarized fluorescence due to their slower rates of rotation as compared to fluorescent tracers attached to smaller molecules (e.g. FITC-labeled peptides that are free in solution). A compound that antagonizes the interaction between the fluoresceinated peptidomimetic macrocycle and an acceptor protein will be detected in a competitive binding FPA experiment.

For example, putative antagonist compounds (1 nM to 1 mM) and a fluoresceinated peptidomimetic macrocycle (25 nM) are incubated with the acceptor protein (50 nM) in binding buffer (140 mM NaCl, 50 mM Tris-HCL, pH 7.4) for 30 minutes at room temperature. Antagonist binding activity is measured, for example, by fluorescence polarization on a luminescence spectrophotometer. Kd values can be determined by nonlinear regression analysis. Any class of molecule, such as small organic molecules, peptides, oligonucleotides or proteins can be examined as putative antagonists in this assay.

g. Assay for Protein-Ligand Binding by Affinity Selection-Mass Spectrometry

To assess the binding and affinity of test compounds for proteins, an affinity-selection mass spectrometry assay is used, for example. Protein-ligand binding experiments are conducted according to the following representative procedure outlined for a system-wide control experiment using 1 μM peptidomimetic macrocycle plus 5 μM hMDM2. A 1 μL DMSO aliquot of a 40 μM stock solution of peptidomimetic macrocycle is dissolved in 19 μL of PBS (50 mM, pH 7.5 Phosphate buffer containing 150 mM NaCl). The resulting solution is mixed by repeated pipetting and clarified by centrifugation at 10 000 g for 10 min. To a 4 μL aliquot of the resulting supernatant is added 4 μL of 10 μM hMDM2 in PBS. Each 8.0 μL experimental sample thus contains 40 pmol (1.5 μg) of protein at 5.0 μM concentration in PBS plus 1 μM peptidomimetic macrocycle and 2.5% DMSO. Duplicate samples thus prepared for each concentration point are incubated for 60 min at room temperature, and then chilled to 4° C. prior to size-exclusion chromatography-LC-MS analysis of 5.0 μL injections. Samples containing a target protein, protein-ligand complexes, and unbound compounds are injected onto an SEC column, where the complexes are separated from non-binding component by a rapid SEC step. The SEC column eluate is monitored using UV detectors to confirm that the early-eluting protein fraction, which elutes in the void volume of the SEC column, is well resolved from unbound components that are retained on the column. After the peak containing the protein and protein-ligand complexes elutes from the primary UV detector, it enters a sample loop where it is excised from the flow stream of the SEC stage and transferred directly to the LC-MS via a valving mechanism. The $(M+3H)^{3+}$ ion of the peptidomimetic macrocycle is observed by ESI-MS at the expected m/z, confirming the detection of the protein-ligand complex.

h. Assay for Protein-Ligand $K_d$ Titration Experiments

To assess the binding and affinity of test compounds for proteins, a protein-ligand Kd titration experiment is performed, for example. Protein-ligand $K_d$ titrations experiments are conducted as follows: 2 µL DMSO aliquots of a serially diluted stock solution of titrant peptidomimetic macrocycle (5, 2.5, . . . , 0.098 mM) are prepared then dissolved in 38 µL of PBS. The resulting solutions are mixed by repeated pipetting and clarified by centrifugation at 10 000 g for 10 min. To 4.0 µL aliquots of the resulting supernatants is added 4.0 µL of 10 µM hMDM2 in PBS. Each 8.0 µL experimental sample thus contains 40 pmol (1.5 µg) of protein at 5.0 µM concentration in PBS, varying concentrations (125, 62.5, . . . , 0.24 µM) of the titrant peptide, and 2.5% DMSO. Duplicate samples thus prepared for each concentration point are incubated at room temperature for 30 min, then chilled to 4° C. prior to SEC-LC-MS analysis of 2.0 µL injections. The $(M+H)^{1+}$, $(M+2H)^{2+}$, $(M+3H)^{3+}$, and/or $(M+Na)^{1+}$ ion is observed by ESI-MS; extracted ion chromatograms are quantified, then fit to equations to derive the binding affinity $K_d$.

i. Assay for Competitive Binding Experiments by Affinity Selection-Mass Spectrometry To determine the ability of test compounds to bind competitively to proteins, an affinity selection mass spectrometry assay is performed, for example. A mixture of ligands at 40 µM per component is prepared by combining 2 µL aliquots of 400 µM stocks of each of the three compounds with 14 µL of DMSO. Then, 1 µL aliquots of this 40 µM per component mixture are combined with 1 µL DMSO aliquots of a serially diluted stock solution of titrant peptidomimetic macrocycle (10, 5, 2.5, . . . , 0.078 mM). These 2 µL samples are dissolved in 38 µL of PBS. The resulting solutions were mixed by repeated pipetting and clarified by centrifugation at 10 000 g for 10 min. To 4.0 µL aliquots of the resulting supernatants is added 4.0 µL of 10 µM hMDM2 protein in PBS. Each 8.0 µL experimental sample thus contains 40 pmol (1.5 µg) of protein at 5.0 µM concentration in PBS plus 0.5 µM ligand, 2.5% DMSO, and varying concentrations (125, 62.5, . . . , 0.98 µM) of the titrant peptidomimetic macrocycle. Duplicate samples thus prepared for each concentration point are incubated at room temperature for 60 min, then chilled to 4° C. prior to SEC-LC-MS analysis of 2.0 µL injections.

j. Binding Assays in Intact Cells

It is possible to measure binding of peptides or peptidomimetic macrocycles to their natural acceptors in intact cells by immunoprecipitation experiments. For example, intact cells are incubated with fluoresceinated (FITC-labeled) compounds for 4 hrs in the absence of serum, followed by serum replacement and further incubation that ranges from 4-18 hrs. Cells are then pelleted and incubated in lysis buffer (50 mM Tris [pH 7.6], 150 mM NaCl, 1% CHAPS and protease inhibitor cocktail) for 10 minutes at 4° C. Extracts are centrifuged at 14,000 rpm for 15 minutes and supernatants collected and incubated with 10 µL goat anti-FITC antibody for 2 hrs, rotating at 4° C. followed by further 2 hrs incubation at 4° C. with protein A/G Sepharose (50 µL of 50% bead slurry). After quick centrifugation, the pellets are washed in lysis buffer containing increasing salt concentration (e.g., 150, 300, 500 mM). The beads are then re-equilibrated at 150 mM NaCl before addition of SDS-containing sample buffer and boiling. After centrifugation, the supernatants are optionally electrophoresed using 4%-12% gradient Bis-Tris gels followed by transfer into Immobilon-P membranes. After blocking, blots are optionally incubated with an antibody that detects FITC and also with one or more antibodies that detect proteins that bind to the peptidomimetic macrocycle.

k. Cellular Penetrability Assays

A peptidomimetic macrocycle is, for example, more cell penetrable compared to a corresponding uncrosslinked macrocycle. Peptidomimetic macrocycles with optimized linkers possess, for example, cell penetrability that is at least two-fold greater than a corresponding uncrosslinked macrocycle, and often 20% or more of the applied peptidomimetic macrocycle will be observed to have penetrated the cell after 4 hours. To measure the cell penetrability of peptidomimetic macrocycles and corresponding uncrosslinked macrocycle, intact cells are incubated with fluorescently-labeled (e.g. fluoresceinated) peptidomimetic macrocycles or corresponding uncrosslinked macrocycle (10 µM) for 4 hrs in serum free media at 37° C., washed twice with media and incubated with trypsin (0.25%) for 10 min at 37° C. The cells are washed again and resuspended in PBS. Cellular fluorescence is analyzed.

l. Cellular Efficacy Assays

The efficacy of certain peptidomimetic macrocycles is determined, for example, in cell-based killing assays using a variety of tumorigenic and non-tumorigenic cell lines and primary cells derived from human or mouse cell populations. Cell viability is monitored, for example, over 24-96 hrs of incubation with peptidomimetic macrocycles (0.5 to 50 µM) to identify those that kill at $EC_{50}<10$ µM. Several standard assays that measure cell viability are commercially available and are optionally used to assess the efficacy of the peptidomimetic macrocycles. In addition, assays that measure Annexin V and caspase activation are optionally used to assess whether the peptidomimetic macrocycles kill cells by activating the apoptotic machinery. For example, the Cell Titer-glo assay is used which determines cell viability as a function of intracellular ATP concentration.

m. In Vivo Stability Assay

To investigate the in vivo stability of the peptidomimetic macrocycles, the compounds are, for example, administered to mice and/or rats by IV, IP, PO or inhalation routes at concentrations ranging from 0.1 to 50 mg/kg and blood specimens withdrawn at 0', 5', 15', 30', 1 hr, 4 hrs, 8 hrs and 24 hours post-injection. Levels of intact compound in 25 µL of fresh serum are then measured by LC-MS/MS as above.

n. In Vivo Efficacy in Animal Models

To determine the anti-oncogenic activity of peptidomimetic macrocycles in vivo, the compounds are, for example, given alone (IP, IV, PO, by inhalation or nasal routes) or in combination with sub-optimal doses of relevant chemotherapy (e.g., cyclophosphamide, doxorubicin, etoposide). In one example, $5 \times 10^6$ RS4; 11 cells (established from the bone marrow of a patient with acute lymphoblastic leukemia) that stably express luciferase are injected by tail vein in NOD-SCID mice 3 hrs after they have been subjected to total body irradiation. If left untreated, this form of leukemia is fatal in 3 weeks in this model. The leukemia is readily monitored, for example, by injecting the mice with D-luciferin (60 mg/kg) and imaging the anesthetized animals. Total body bioluminescence is quantified by integration of photonic flux (photons/sec) by Living Image Software. Peptidomimetic macrocycles alone or in combination with sub-optimal doses of relevant chemotherapeutics agents are, for example, administered to leukemic mice (10 days after injection/day 1 of experiment, in bioluminescence range of 14-16) by tail vein or IP routes at doses ranging from 0.1 mg/kg to 50 mg/kg for 7 to 21 days. Optionally, the mice are imaged throughout the experiment every other day and survival monitored daily for the duration of the experiment. Expired mice are optionally subjected to necropsy at the end of the experiment. Another animal model is implantation into NOD-SCID mice of DoHH2, a cell line derived from human follicular lymphoma that stably expresses luciferase. These in vivo tests optionally generate preliminary pharmacokinetic, pharmacodynamic and toxicology data.

o. Clinical Trials

To determine the suitability of the peptidomimetic macrocycles for treatment of humans, clinical trials are performed. For example, patients diagnosed with cancer and in need of treatment can be selected and separated in treatment and one or more control groups, wherein the treatment group is administered a peptidomimetic macrocycle, while the control groups receive a placebo or a known anti-cancer drug. The treatment safety and efficacy of the peptidomimetic macrocycles can thus be evaluated by performing comparisons of the patient groups with respect to factors such as survival and quality-of-life. In this example, the patient group treated with a peptidomimetic macrocycle can show improved long-term survival compared to a patient control group treated with a placebo.

EXAMPLES

Example 1: Synthesis of 6-Chlorotryptophan Fmoc Amino Acids

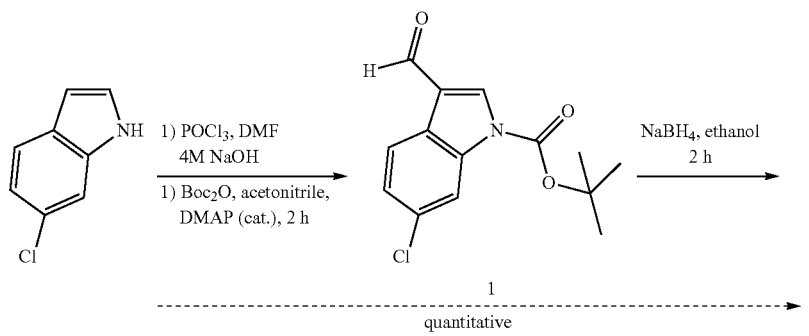

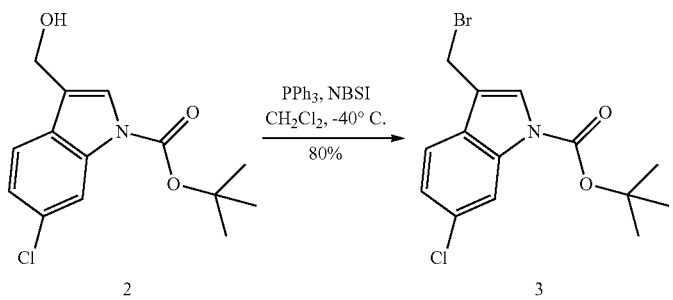

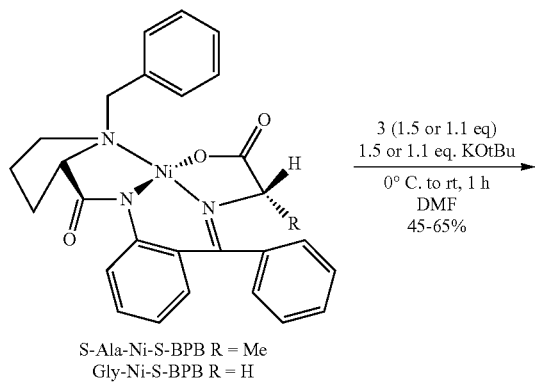

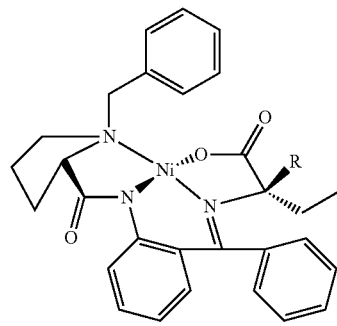

4, R = Me
5, R = H 1) 3N HCl/MeOH 52° C., 3 h
2) Na₂CO₃, 0° C.
3) EDTA disodium, 1 h, rt
4) FmocOSu in acetone, rt overnight
70%

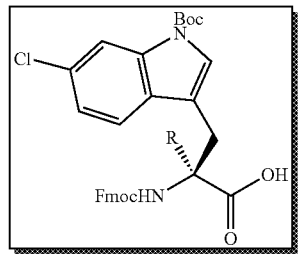

6, R = Me
7, R = H

Tert-butyl 6-chloro-3-formyl-1H-indole-1-carboxylate, 1

To a stirred solution of dry DMF (12 mL) was added dropwise POCl₃ (3.92 mL, 43 mmol, 1.3 equiv) at 0° C. under argon. The solution was stirred at 0° C. for 20 min before a solution of 6-chloroindole (5.0 g, 33 mmol, 1 eq.) in dry DMF (30 mL) was added dropwise. The resulting mixture was warmed to room temperature and stirred for an additional 2.5 h. Water (50 mL) was added to the reaction mixture, and the solution was neutralized with 4M aqueous NaOH (pH~8). The resulting solid was filtered off, washed with water, and dried under vacuum. This material was used in the next step without additional purification.

To a stirred solution of the crude formyl indole (33 mmol, 1 eq.) in THF (150 mL) was added successively Boc₂O (7.91 g, 36.3 mmol, 1.1 equiv) and DMAP (0.4 g, 3.3 mmol, 0.1 equiv) at room temperature under N₂. The resulting mixture was stirred at room temperature for 1.5 h, and the solvent was evaporated under reduced pressure. The residue was taken up in EtOAc and washed with 1N HCl, dried, and concentrated to afford formyl indole 1 (9 g, 98% over 2 steps) as a white solid. $^1$H NMR (CDCl₃) δ: 1.70 (s, Boc, 9H); 7.35 (dd, 1H); 8.21 (m, 3H); 10.07 (s, 1H).

Tert-butyl 6-chloro-3-(hydroxymethyl)-1H-indole-1-carboxylate, 2

To a solution of compound 1 (8.86 g, 32 mmol, 1 eq.) in ethanol (150 mL) was added NaBH₄ (2.4 g, 63 mmol, 2 eq.). The reaction was stirred for 3 h at room temperature. The reaction mixture was concentrated, and the residue was poured into diethyl ether and water. The organic layer was separated, dried over magnesium sulfate, and concentrated to give a white solid (8.7 g, 98%). This material was directly used in the next step without additional purification. $^1$H NMR (CDCl₃) δ: 1.65 (s, Boc, 9H); 4.80 (s, 2H, CH₂); 7.21 (dd, 1H); 7.53 (m, 2H); 8.16 (bs, 1H).

Tert-butyl 3-(bromomethyl)-6-chloro-1H-indole-1-carboxylate, 3

To a solution of compound 2 (4.1 g, 14.6 mmol, 1 eq.) in dichloromethane (50 mL) under argon was added a solution of triphenylphosphine (4.59 g, 17.5 mmol, 1.2 eq.) in dichloromethane (50 mL) at −40° C. The reaction was stirred for 30 min at 40° C. NBS (3.38 g, 19 mmol, 1.3 eq.) was then added to the reaction mixture. The resulting mixture was warmed to room temperature and stirred overnight. Dichloromethane was evaporated, carbon tetrachloride (100 mL) was added, and the mixture was stirred for 1 h and filtrated. The filtrate was concentrated, loaded on a silica plug, and quickly eluted with 25% EtOAc in hexanes. The solution was concentrated to afford a white foam (3.84 g, 77%). $^1$H NMR (CDCl₃) δ: 1.66 (s, Boc, 9H); 4.63 (s, 2H, CH₂); 7.28 (dd, 1H); 7.57 (d, 1H); 7.64 (bs, 1H); 8.18 (bs, 1H).

αMe-6Cl-Trp(Boc)-Ni—S—BPB, 4

To S-Ala-Ni—S—BPB (2.66 g, 5.2 mmol, 1 eq.) and KO-tBu (0.87 g, 7.8 mmol, 1.5 eq.) was added 50 mL of DMF under argon. The bromide derivative compound 3 (2.68 g, 7.8 mmol, 1.5 eq.) was dissolved in DMF (5.0 mL) and added to the reaction mixture using a syringe. The reaction mixture was stirred at ambient temperature for 1 h. The solution was then quenched with 5% aqueous acetic acid and diluted with water. The desired product was extracted in dichloromethane, dried, and concentrated. The oily product 4 was purified by flash chromatography (solid loading) on normal phase using EtOAc and hexanes as eluents to give a red solid (1.78 g, 45% yield). M+H calc. 775.21, M+H obs. 775.26; $^1$H NMR (CDCl₃) δ: 1.23 (s, 3H, αMe); 1.56 (m, 11H, Boc+CH₂); 1.82-2.20 (m, 4H, 2CH₂); 3.03 (m, 1H, CH$_α$); 3.24 (m, 2H, CH₂); 3.57 and 4.29 (AB system, 2H, CH₂ (benzyl), J=12.8 Hz); 6.62 (d, 2H); 6.98 (d, 1H); 7.14 (m, 2H); 7.23 (m, 1H); 7.32-7.36 (m, 5H); 7.50 (m, 2H); 7.67 (bs, 1H); 7.98 (d, 2H); 8.27 (m, 2H).

6Cl-Trp(Boc)-Ni—S—BPB, 5

To Gly-Ni—S—BPB (4.6 g, 9.2 mmol, 1 eq.) and KO-tBu (1.14 g, 10.1 mmol, 1.1 eq.) was added 95 mL of DMF under argon. The bromide derivative compound 3 (3.5 g, 4.6 mmol, 1.1 eq.) was dissolved in DMF (10 mL) and added to the reaction mixture using a syringe. The reaction mixture was stirred at ambient temperature for 1 h. The solution was then quenched with 5% aqueous acetic acid and diluted with water. The desired product was extracted in dichloromethane, dried and concentrated. The oily product 5 was purified by flash chromatography (solid loading) on normal phase using EtOAc and hexanes as eluents to give a red solid (5 g, 71% yield). M+H calc. 761.20, M+H obs. 761.34; $^1$H NMR (CDCl₃) δ: 1.58 (m, 11H, Boc+CH₂); 1.84 (m, 2H, 1H); 2.24 (m, 2H, CH₂); 3.00 (m, 1H, CH$_α$); 3.22 (m, 2H, CH₂); 3.45 and 4.25 (AB system, 2H, CH₂ (benzyl), J=12.8 Hz); 4.27 (m, 1H, CH$_α$); 6.65 (d, 2H); 6.88 (d, 1H); 7.07 (m, 2H); 7.14 (m, 2H); 7.28 (m, 3H); 7.35-7.39 (m, 2H); 7.52 (m, 2H); 7.96 (d, 2H); 8.28 (m, 2H).

Fmoc-αMe-6Cl-Trp(Boc)-OH, 6

To a solution of 3N HCl/MeOH (1/3, 15 mL) at 50° C. was added a solution of compound 4 (1.75 g, 2.3 mmol, 1 eq.) in MeOH (5 ml) dropwise. The starting material disappeared within 3-4 h. The acidic solution was then cooled to 0° C. with an ice bath and quenched with an aqueous solution of $Na_2CO_3$ (1.21 g, 11.5 mmol, 5 eq.). Methanol was removed and 8 eq. of $Na_2CO_3$ (1.95 g, 18.4 mmol) were added to the suspension. EDTA disodium salt dihydrate (1.68 g, 4.5 mmol, 2 eq.) was then added, and the resulting suspension was stirred for 2 h. A solution of Fmoc-OSu (0.84 g, 2.5 mmol, 1.1 eq.) in acetone (50 mL) was added, and the reaction was stirred overnight. The reaction was diluted with diethyl ether and 1N HCl. The organic layer was then dried over magnesium sulfate and concentrated in vacuo. The desired product 6 was purified on normal phase using acetone and dichloromethane as eluents to give a white foam (0.9 g, 70% yield). M+H calc. 575.19, M+H obs. 575.37; $^1$H NMR ($CDCl_3$) 1.59 (s, 9H, Boc); 1.68 (s, 3H, Me); 3.48 (bs, 2H, $CH_2$); 4.22 (m, 1H, CH); 4.39 (bs, 2H, $CH_2$); 5.47 (s, 1H, NH); 7.10 (m, 1H); 7.18 (m, 2H); 7.27 (m, 2H); 7.39 (m, 2H); 7.50 (m, 2H); 7.75 (d, 2H); 8.12 (bs, 1H).

Fmoc-6Cl-Trp(Boc)-OH, 7

To a solution of 3N HCl/MeOH (1/3, 44 mL) at 50° C. was added a solution of compound 5 (5 g, 6.6 mmol, 1 eq.) in MeOH (10 ml) dropwise. The starting material disappeared within 3-4 h. The acidic solution was then cooled to 0° C. with an ice bath and quenched with an aqueous solution of $Na_2CO_3$ (3.48 g, 33 mmol, 5 eq.). Methanol was removed and 8 eq. of $Na_2CO_3$ (5.57 g, 52 mmol) were added to the suspension. EDTA disodium salt dihydrate (4.89 g, 13.1 mmol, 2 eq.) was added to the suspension, and the resulting suspension was stirred for 2 h. A solution of Fmoc-OSu (2.21 g, 6.55 mmol, 1.1 eq.) in acetone (100 mL) was added, and the reaction was stirred overnight. The reaction was diluted with diethyl ether and 1N HCl. The organic layer was then dried over magnesium sulfate and concentrated in vacuo. The desired product 7 was purified on normal phase using acetone and dichloromethane as eluents to give a white foam (2.6 g, 69% yield). M+H calc. 561.17, M+H obs. 561.37; $^1$H NMR ($CDCl_3$) 1.63 (s, 9H, Boc); 3.26 (m, 2H, $CH_2$); 4.19 (m, 1H, CH); 4.39 (m, 2H, $CH_2$); 4.76 (m, 1H); 5.35 (d, 1H, NH); 7.18 (m, 2H); 7.28 (m, 2H); 7.39 (m, 3H); 7.50 (m, 2H); 7.75 (d, 2H); 8.14 (bs, 1H).

Example 2: Peptidomimetic Macrocycles

Peptidomimetic macrocycles were designed by replacing two or more naturally-occurring amino acids with the corresponding synthetic amino acids. Substitutions were made at i and i+4, and i and i+7 positions. Peptide synthesis was performed manually or using an automated peptide synthesizer under solid phase conditions using rink amide AM resin and Fmoc main-chain protecting group chemistry. For the coupling of natural Fmoc-protected amino acids, 10 eq. of amino acid and a 1:1:2 molar ratio of coupling reagents HBTU/HOBt/DIEA were employed. Non-natural amino acids (4 eq.) were coupled with a 1:1:2 molar ratio of HATU/HOBt/DIEA. The N-termini of the synthetic peptides were acetylated, and the C-termini were amidated.

Purification of crosslinked compounds was achieved by HPLC on a reverse phase C18 column to yield the pure compounds. The chemical compositions of the pure products were confirmed by LC/MS mass spectrometry and amino acid analysis.

Synthesis of Dialkyne-Crosslinked Peptidomimetic Macrocycles, Including SP662, SP663 and SP664.

Fully protected resin-bound peptides were synthesized on a PEG-PS resin (loading 0.45 mmol/g) on a 0.2 mmol scale. Deprotection of the temporary Fmoc group was achieved by 3×10 min treatments of the resin bound peptide with 20% (v/v) piperidine in DMF. After washing with NMP (3×), dichloromethane (3×) and NMP (3×), coupling of each successive amino acid was achieved with 1×60 min incubation with the appropriate pre-activated Fmoc-amino acid derivative. All protected amino acids (0.4 mmol) were dissolved in NMP and activated with HCTU (0.4 mmol) and DIEA (0.8 mmol) prior to transfer of the coupling solution to the de-protected resin-bound peptide. After coupling was completed, the resin was washed in preparation for the next deprotection/coupling cycle.

Acetylation of the amino terminus was carried out in the presence of acetic anhydride/DIEA in NMP. The LC-MS analysis of a cleaved and de-protected sample obtained from an aliquot of the fully assembled resin-bound peptide was accomplished in order to verifying the completion of each coupling. In a typical example, tetrahydrofuran (4 ml) and triethylamine (2 ml) were added to the peptide resin (0.2 mmol) in a 40 ml glass vial and shaken for 10 minutes. $Pd(PPh_3)_2Cl_2$ (0.014 g, 0.02 mmol) and copper iodide (0.008 g, 0.04 mmol) were then added and the resulting reaction mixture was mechanically shaken 16 hours while open to atmosphere. The diyne-cyclized resin-bound peptides were de-protected and cleaved from the solid support by treatment with $TFA/H_2O/TIS$ (95/5/5 v/v) for 2.5 h at room temperature. After filtration of the resin the TFA solution was precipitated in cold diethyl ether and centrifuged to yield the desired product as a solid. The crude product was purified by preparative HPLC.

Synthesis of Single Alkyne-Crosslinked Peptidomimetic Macrocycles, Including SP665.

Fully protected resin-bound peptides were synthesized on a Rink amide MBHA resin (loading 0.62 mmol/g) on a 0.1 mmol scale. Deprotection of the temporary Fmoc group was achieved by 2×20 min treatments of the resin bound peptide with 25% (v/v) piperidine in NMP. After extensive flow washing with NMP and dichloromethane, coupling of each successive amino acid was achieved with 1×60 min incubation with the appropriate pre-activated Fmoc-amino acid derivative. All protected amino acids (1 mmol) were dissolved in NMP and activated with HCTU (1 mmol) and DIEA (1 mmol) prior to transfer of the coupling solution to the de-protected resin-bound peptide. After coupling was completed, the resin was extensively flow washed in preparation for the next deprotection/coupling cycle.

Acetylation of the amino terminus was carried out in the presence of acetic anhydride/DIEA in NMP/NMM. The LC-MS analysis of a cleaved and de-protected sample obtained from an aliquot of the fully assembled resin-bound peptide was accomplished to verify the completion of each coupling reaction. In a typical example, the peptide resin (0.1 mmol) was washed with DCM. Resin was loaded into a microwave vial. The vessel was evacuated and purged with nitrogen. Molybdenum hexacarbonyl (0.01 eq.) was added. Anhydrous chlorobenzene was added to the reaction vessel. Then 2-fluorophenol (1 eq.) was added. The reaction was then loaded into the microwave and held at 130° C. for 10 minutes. The reaction pushed for a longer period time when needed to complete the reaction. The alkyne-metathesized resin-bound peptides were de-protected and cleaved from the solid support by treating the solid support with TFA/H$_2$O/TIS (94/3/3 v/v) for 3 h at room temperature. After filtration of the resin, the TFA solution was precipitated in cold diethyl ether and centrifuged to yield the desired product as a solid. The crude product was purified by preparative HPLC.

TABLE 1 shows a list of peptidomimetic macrocycles prepared.

TABLE 1

| SP | Sequence | SEQ ID NO: | Isomer | Exact Mass | Found Mass | Calc (M+1)/1 | Calc (M+2)/2 | Calc (m+3)/3 |
|---|---|---|---|---|---|---|---|---|
| 1 | Ac-F$r8AYWEAc3cL$AAA-NH$_2$ | 1 | | 1456.78 | 729.44 | 1457.79 | 729.4 | 486.6 |
| 2 | Ac-F$r8AYWEAc3cL$AAibA-NH$_2$ | 2 | | 1470.79 | 736.4 | 1471.8 | 736.4 | 491.27 |
| 3 | Ac-LTF$r8AYWAQL$SANle-NH$_2$ | 3 | | 1715.97 | 859.02 | 1716.98 | 858.99 | 573 |
| 4 | Ac-LTF$r8AYWAQL$SAL-NH$_2$ | 4 | | 1715.97 | 859.02 | 1716.98 | 858.99 | 573 |
| 5 | Ac-LTF$r8AYWAQL$SAM-NH$_2$ | 5 | | 1733.92 | 868.48 | 1734.93 | 867.97 | 578.98 |
| 6 | Ac-LTF$r8AYWAQL$SAhL-NH$_2$ | 6 | | 1729.98 | 865.98 | 1730.99 | 866 | 577.67 |
| 7 | Ac-LTF$r8AYWAQL$SAF-NH$_2$ | 7 | | 1749.95 | 876.36 | 1750.96 | 875.98 | 584.32 |
| 8 | Ac-LTF$r8AYWAQL$SAI-NH$_2$ | 8 | | 1715.97 | 859.02 | 1716.98 | 858.99 | 573 |
| 9 | Ac-LTF$r8AYWAQL$SAChg-NH$_2$ | 9 | | 1741.98 | 871.98 | 1742.99 | 872 | 581.67 |
| 10 | Ac-LTF$r8AYWAQL$SAAib-NH$_2$ | 10 | | 1687.93 | 845.36 | 1688.94 | 844.97 | 563.65 |
| 11 | Ac-LTF$r8AYWAQL$SAA-NH$_2$ | 11 | | 1673.92 | 838.01 | 1674.93 | 837.97 | 558.98 |
| 12 | Ac-LTF$r8AYWA$L$S$Nle-NH$_2$ | 12 | | 1767.04 | 884.77 | 1768.05 | 884.53 | 590.02 |
| 13 | Ac-LTF$r8AYWA$L$S$A-NH$_2$ | 13 | | 1724.99 | 864.23 | 1726 | 863.5 | 576 |
| 14 | Ac-F$r8AYWEAc3cL$AANle-NH$_2$ | 14 | | 1498.82 | 750.46 | 1499.83 | 750.42 | 500.61 |
| 15 | Ac-F$r8AYWEAc3cL$AAL-NH$_2$ | 15 | | 1498.82 | 750.46 | 1499.83 | 750.42 | 500.61 |
| 16 | Ac-F$r8AYWEAc3cL$AAM-NH$_2$ | 16 | | 1516.78 | 759.41 | 1517.79 | 759.4 | 506.6 |
| 17 | Ac-F$r8AYWEAc3cL$AAhL-NH$_2$ | 17 | | 1512.84 | 757.49 | 1513.85 | 757.43 | 505.29 |
| 18 | Ac-F$r8AYWEAc3cL$AAF-NH$_2$ | 18 | | 1532.81 | 767.48 | 1533.82 | 767.41 | 511.94 |
| 19 | Ac-F$r8AYWEAc3cL$AAI-NH$_2$ | 19 | | 1498.82 | 750.39 | 1499.83 | 750.42 | 500.61 |
| 20 | Ac-F$r8AYWEAc3cL$AAChg-NH$_2$ | 20 | | 1524.84 | 763.48 | 1525.85 | 763.43 | 509.29 |
| 21 | Ac-F$r8AYWEAc3cL$AACha-NH$_2$ | 21 | | 1538.85 | 770.44 | 1539.86 | 770.43 | 513.96 |
| 22 | Ac-F$r8AYWEAc3cL$AAAib-NH$_2$ | 22 | | 1470.79 | 736.84 | 1471.8 | 736.4 | 491.27 |
| 23 | Ac-LTF$r8AYWAQL$AAAibV-NH$_2$ | 23 | | 1771.01 | 885.81 | 1772.02 | 886.51 | 591.34 |
| 24 | Ac-LTF$r8AYWAQL$AAAibV-NH$_2$ | 24 | iso2 | 1771.01 | 886.26 | 1772.02 | 886.51 | 591.34 |
| 25 | Ac-LTF$r8AYWAQL$SAibAA-NH$_2$ | 25 | | 1758.97 | 879.89 | 1759.98 | 880.49 | 587.33 |
| 26 | Ac-LTF$r8AYWAQL$SAibAA-NH$_2$ | 26 | iso2 | 1758.97 | 880.34 | 1759.98 | 880.49 | 587.33 |
| 27 | Ac-HLTF$r8HHWHQL$AANleNle-NH$_2$ | 27 | | 2056.15 | 1028.86 | 2057.16 | 1029.08 | 686.39 |
| 28 | Ac-DLTF$r8HHWHQL$RRLV-NH$_2$ | 28 | | 2190.23 | 731.15 | 2191.24 | 1096.12 | 731.08 |
| 29 | Ac-HHTF$r8HHWHQL$AAML-NH$_2$ | 29 | | 2098.08 | 700.43 | 2099.09 | 1050.05 | 700.37 |
| 30 | Ac-F$r8HHWHQL$RRDCha-NH$_2$ | 30 | | 1917.06 | 959.96 | 1918.07 | 959.54 | 640.03 |
| 31 | Ac-F$r8HHWHQL$HRFV-NH$_2$ | 31 | | 1876.02 | 938.65 | 1877.03 | 939.02 | 626.35 |
| 32 | Ac-HLTF$r8HHWHQL$AAhLA-NH$_2$ | 32 | | 2028.12 | 677.2 | 2029.13 | 1015.07 | 677.05 |
| 33 | Ac-DLTF$r8HHWHQL$RRChgl-NH$_2$ | 33 | | 2230.26 | 1115.89 | 2231.27 | 1116.14 | 744.43 |
| 34 | Ac-DLTF$r8HHWHQL$RRChgl-NH$_2$ | 34 | iso2 | 2230.26 | 1115.96 | 2231.27 | 1116.14 | 744.43 |

TABLE 1-continued

| SP Sequence | SEQ ID NO: | Isomer | Exact Mass | Found Mass | Calc (M+1)/1 | Calc (M+2)/2 | Calc (m+3)/3 |
|---|---|---|---|---|---|---|---|
| 35 Ac-HHTF$r8HHWHQL$AAChav-NH2 | 35 | | 2106.14 | 1053.95 | 2107.15 | 1054.08 | 703.05 |
| 36 Ac-F$r8HHWHQL$RRDa-NH2 | 36 | | 1834.99 | 918.3 | 1836 | 918.5 | 612.67 |
| 37 Ac-F$r8HHWHQL$HRAibG-NH2 | 37 | | 1771.95 | 886.77 | 1772.96 | 886.98 | 591.66 |
| 38 Ac-F$r8AYWAQL$HHNleL-NH2 | 38 | | 1730.97 | 866.57 | 1731.98 | 866.49 | 578 |
| 39 Ac-F$r8AYWSAL$HQNle-NH2 | 39 | | 1638.89 | 820.54 | 1639.9 | 820.45 | 547.3 |
| 40 Ac-F$r8AYWVQL$QHChgl-NH2 | 40 | | 1776.01 | 889.44 | 1777.02 | 889.01 | 593.01 |
| 41 Ac-F$r8AYWTAL$QQNlev-NH2 | 41 | | 1671.94 | 836.97 | 1672.95 | 836.98 | 558.32 |
| 42 Ac-F$r8AYWYQL$HAibAa-NH2 | 42 | | 1686.89 | 844.52 | 1687.9 | 844.45 | 563.3 |
| 43 Ac-LTF$r8AYWAQL$HHLa-NH2 | 43 | | 1903.05 | 952.27 | 1904.06 | 952.53 | 635.36 |
| 44 Ac-LTF$r8AYWAQL$HHLa-NH2 | 44 | iso2 | 1903.05 | 952.27 | 1904.06 | 952.53 | 635.36 |
| 45 Ac-LTF$r8AYWAQL$HQNlev-NH2 | 45 | | 1922.08 | 962.48 | 1923.09 | 962.05 | 641.7 |
| 46 Ac-LTF$r8AYWAQL$HQNlev-NH2 | 46 | iso2 | 1922.08 | 962.4 | 1923.09 | 962.05 | 641.7 |
| 47 Ac-LTF$r8AYWAQL$QQMl-NH2 | 47 | | 1945.05 | 973.95 | 1946.06 | 973.53 | 649.36 |
| 48 Ac-LTF$r8AYWAQL$QQMl-NH2 | 48 | iso2 | 1945.05 | 973.88 | 1946.06 | 973.53 | 649.36 |
| 49 Ac-LTF$r8AYWAQL$HAibhLV-NH2 | 49 | | 1893.09 | 948.31 | 1894.1 | 947.55 | 632.04 |
| 50 Ac-LTF$r8AYWAQL$AHFA-NH2 | 50 | | 1871.01 | 937.4 | 1872.02 | 936.51 | 624.68 |
| 51 Ac-HLTF$r8HHWHQL$AANlel-NH2 | 51 | | 2056.15 | 1028.79 | 2057.16 | 1029.08 | 686.39 |
| 52 Ac-DLTF$r8HHWHQL$RRLa-NH2 | 52 | | 2162.2 | 721.82 | 2163.21 | 1082.11 | 721.74 |
| 53 Ac-HHTF$r8HHWHQL$AAMv-NH2 | 53 | | 2084.07 | 1042.92 | 2085.08 | 1043.04 | 695.7 |
| 54 Ac-F$r8HHWHQL$RRDA-NH2 | 54 | | 1834.99 | 612.74 | 1836 | 918.5 | 612.67 |
| 55 Ac-F$r8HHWHQL$HRFCha-NH2 | 55 | | 1930.06 | 966.47 | 1931.07 | 966.04 | 644.36 |
| 56 Ac-F$r8AYWEAL$AA-NHAm | 56 | | 1443.82 | 1445.71 | 1444.83 | 722.92 | 482.28 |
| 57 Ac-F$r8AYWEAL$AA-NHiAm | 57 | | 1443.82 | 723.13 | 1444.83 | 722.92 | 482.28 |
| 58 Ac-F$r8AYWEAL$AA-NHnPr3Ph | 58 | | 1491.82 | 747.3 | 1492.83 | 746.92 | 498.28 |
| 59 Ac-F$r8AYWEAL$AA-NHnBu33Me | 59 | | 1457.83 | 1458.94 | 1458.84 | 729.92 | 486.95 |
| 60 Ac-F$r8AYWEAL$AA-NHnPr | 60 | | 1415.79 | 709.28 | 1416.8 | 708.9 | 472.94 |
| 61 Ac-F$r8AYWEAL$AA-NHnEt2Ch | 61 | | 1483.85 | 1485.77 | 1484.86 | 742.93 | 495.62 |
| 62 Ac-F$r8AYWEAL$AA-NHnEt2Cp | 62 | | 1469.83 | 1470.78 | 1470.84 | 735.92 | 490.95 |
| 63 Ac-F$r8AYWEAL$AA-NHHex | 63 | | 1457.83 | 730.19 | 1458.84 | 729.92 | 486.95 |
| 64 Ac-LTF$r8AYWAQL$AAIA-NH2 | 64 | | 1771.01 | 885.81 | 1772.02 | 886.51 | 591.34 |
| 65 Ac-LTF$r8AYWAQL$AAIA-NH2 | 65 | iso2 | 1771.01 | 866.8 | 1772.02 | 886.51 | 591.34 |
| 66 Ac-LTF$r8AYWAAL$AAMA-NH2 | 66 | | 1731.94 | 867.08 | 1732.95 | 866.98 | 578.32 |
| 67 Ac-LTF$r8AYWAAL$AAMA-NH2 | 67 | iso2 | 1731.94 | 867.28 | 1732.95 | 866.98 | 578.32 |
| 68 Ac-LTF$r8AYWAQL$AANleA-NH2 | 68 | | 1771.01 | 867.1 | 1772.02 | 886.51 | 591.34 |
| 69 Ac-LTF$r8AYWAQL$AANleA-NH2 | 69 | iso2 | 1771.01 | 886.89 | 1772.02 | 886.51 | 591.34 |
| 70 Ac-LTF$r8AYWAQL$AAIa-NH2 | 70 | | 1771.01 | 886.8 | 1772.02 | 886.51 | 591.34 |
| 71 Ac-LTF$r8AYWAQL$AAIa-NH2 | 71 | iso2 | 1771.01 | 887.09 | 1772.02 | 886.51 | 591.34 |
| 72 Ac-LTF$r8AYWAAL$AAMa-NH2 | 72 | | 1731.94 | 867.17 | 1732.95 | 866.98 | 578.32 |

TABLE 1-continued

| SP Sequence | SEQ ID NO: | Isomer | Exact Mass | Found Mass | Calc (M+1)/1 | Calc (M+2)/2 | Calc (m+3)/3 |
|---|---|---|---|---|---|---|---|
| 73 Ac-LTF$r8AYWAAL$AAMa-NH₂ | 73 | iso2 | 1731.94 | 867.37 | 1732.95 | 866.98 | 578.32 |
| 74 Ac-LTF$r8AYWAQL$AANlea-NH₂ | 74 | | 1771.01 | 887.08 | 1772.02 | 886.51 | 591.34 |
| 75 Ac-LTF$r8AYWAQL$AANlea-NH₂ | 75 | iso2 | 1771.01 | 887.08 | 1772.02 | 886.51 | 591.34 |
| 76 Ac-LTF$r8AYWAAL$AAIv-NH₂ | 76 | | 1742.02 | 872.37 | 1743.03 | 872.02 | 581.68 |
| 77 Ac-LTF$r8AYWAAL$AAIv-NH₂ | 77 | iso2 | 1742.02 | 872.74 | 1743.03 | 872.02 | 581.68 |
| 78 Ac-LTF$r8AYWAQL$AAMv-NH₂ | 78 | | 1817 | 910.02 | 1818.01 | 909.51 | 606.67 |
| 79 Ac-LTF$r8AYWAAL$AANlev-NH₂ | 79 | | 1742.02 | 872.37 | 1743.03 | 872.02 | 581.68 |
| 80 Ac-LTF$r8AYWAAL$AANlev-NH₂ | 80 | iso2 | 1742.02 | 872.28 | 1743.03 | 872.02 | 581.68 |
| 81 Ac-LTF$r8AYWAQL$AAIl-NH₂ | 81 | | 1813.05 | 907.81 | 1814.06 | 907.53 | 605.36 |
| 82 Ac-LTF$r8AYWAQL$AAIl-NH₂ | 82 | iso2 | 1813.05 | 907.81 | 1814.06 | 907.53 | 605.36 |
| 83 Ac-LTF$r8AYWAAL$AAMl-NH₂ | 83 | | 1773.99 | 887.37 | 1775 | 888 | 592.34 |
| 84 Ac-LTF$r8AYWAQL$AANlel-NH₂ | 84 | | 1813.05 | 907.61 | 1814.06 | 907.53 | 605.36 |
| 85 Ac-LTF$r8AYWAQL$AANlel-NH₂ | 85 | iso2 | 1813.05 | 907.71 | 1814.06 | 907.53 | 605.36 |
| 86 Ac-F$r8AYWEAL$AAMA-NH₂ | 86 | | 1575.82 | 789.02 | 1576.83 | 788.92 | 526.28 |
| 87 Ac-F$r8AYWEAL$AANleA-NH₂ | 87 | | 1557.86 | 780.14 | 1558.87 | 779.94 | 520.29 |
| 88 Ac-F$r8AYWEAL$AAIa-NH₂ | 88 | | 1557.86 | 780.33 | 1558.87 | 779.94 | 520.29 |
| 89 Ac-F$r8AYWEAL$AAMa-NH₂ | 89 | | 1575.82 | 789.3 | 1576.83 | 788.92 | 526.28 |
| 90 Ac-F$r8AYWEAL$AANlea-NH₂ | 90 | | 1557.86 | 779.4 | 1558.87 | 779.94 | 520.29 |
| 91 Ac-F$r8AYWEAL$AAIv-NH₂ | 91 | | 1585.89 | 794.29 | 1586.9 | 793.95 | 529.64 |
| 92 Ac-F$r8AYWEAL$AAMv-NH₂ | 92 | | 1603.85 | 803.08 | 1604.86 | 802.93 | 535.62 |
| 93 Ac-F$r8AYWEAL$AANlev-NH₂ | 93 | | 1585.89 | 793.46 | 1586.9 | 793.95 | 529.64 |
| 94 Ac-F$r8AYWEAL$AAIl-NH₂ | 94 | | 1599.91 | 800.49 | 1600.92 | 800.96 | 534.31 |
| 95 Ac-F$r8AYWEAL$AAMl-NH₂ | 95 | | 1617.86 | 809.44 | 1618.87 | 809.94 | 540.29 |
| 96 Ac-F$r8AYWEAL$AANlel-NH₂ | 96 | | 1599.91 | 801.7 | 1600.92 | 800.96 | 534.31 |
| 97 Ac-F$r8AYWEAL$AANlel-NH₂ | 97 | iso2 | 1599.91 | 801.42 | 1600.92 | 800.96 | 534.31 |
| 98 Ac-LTF$r8AY6clWAQL$SAA-NH₂ | 98 | | 1707.88 | 855.72 | 1708.89 | 854.95 | 570.3 |
| 99 Ac-LTF$r8AY6clWAQL$SAA-NH₂ | 99 | iso2 | 1707.88 | 855.35 | 1708.89 | 854.95 | 570.3 |
| 100 Ac-WTF$r8FYWSQL$AVAa-NH₂ | 100 | | 1922.01 | 962.21 | 1923.02 | 962.01 | 641.68 |
| 101 Ac-WTF$r8FYWSQL$AVAa-NH₂ | 101 | iso2 | 1922.01 | 962.49 | 1923.02 | 962.01 | 641.68 |
| 102 Ac-WTF$r8VYWSQL$AVA-NH₂ | 102 | | 1802.98 | 902.72 | 1803.99 | 902.5 | 602 |
| 103 Ac-WTF$r8VYWSQL$AVA-NH₂ | 103 | iso2 | 1802.98 | 903 | 1803.99 | 902.5 | 602 |
| 104 Ac-WTF$r8FYWSQL$SAAa-NH₂ | 104 | | 1909.98 | 956.47 | 1910.99 | 956 | 637.67 |
| 105 Ac-WTF$r8FYWSQL$SAAa-NH₂ | 105 | iso2 | 1909.98 | 956.47 | 1910.99 | 956 | 637.67 |
| 106 Ac-WTF$r8VYWSQL$AVAaa-NH₂ | 106 | | 1945.05 | 974.15 | 1946.06 | 973.53 | 649.36 |
| 107 Ac-WTF$r8VYWSQL$AVAaa-NH₂ | 107 | iso2 | 1945.05 | 973.78 | 1946.06 | 973.53 | 649.36 |
| 108 Ac-LTF$r8AYWAQL$AVG-NH₂ | 108 | | 1671.94 | 837.52 | 1672.95 | 836.98 | 558.32 |
| 109 Ac-LTF$r8AYWAQL$AVG-NH₂ | 109 | iso2 | 1671.94 | 837.21 | 1672.95 | 836.98 | 558.32 |
| 110 Ac-LTF$r8AYWAQL$AVQ-NH₂ | 110 | | 1742.98 | 872.74 | 1743.99 | 872.5 | 582 |

TABLE 1-continued

| SP Sequence | SEQ ID NO: | Isomer | Exact Mass | Found Mass | Calc (M+1)/1 | Calc (M+2)/2 | Calc (m+3)/3 |
|---|---|---|---|---|---|---|---|
| 111Ac-LTF$r8AYWAQL$AVQ-NH₂ | 111 | iso2 | 1742.98 | 872.74 | 1743.99 | 872.5 | 582 |
| 112Ac-LTF$r8AYWAQL$SAa-NH₂ | 112 | | 1673.92 | 838.23 | 1674.93 | 837.97 | 558.98 |
| 113Ac-LTF$r8AYWAQL$SAa-NH₂ | 113 | iso2 | 1673.92 | 838.32 | 1674.93 | 837.97 | 558.98 |
| 114Ac-LTF$r8AYWAQhL$SAA-NH₂ | 114 | | 1687.93 | 844.37 | 1688.94 | 844.97 | 563.65 |
| 115Ac-LTF$r8AYWAQhL$SAA-NH₂ | 115 | iso2 | 1687.93 | 844.81 | 1688.94 | 844.97 | 563.65 |
| 116Ac-LTF$r8AYWEQLStSAS-NH₂ | 116 | | 1826 | 905.27 | 1827.01 | 914.01 | 609.67 |
| 117Ac-LTF$r8AYWAQL$SLA-NH₂ | 117 | | 1715.97 | 858.48 | 1716.98 | 858.99 | 573 |
| 118Ac-LTF$r8AYWAQL$SLA-NH₂ | 118 | iso2 | 1715.97 | 858.87 | 1716.98 | 858.99 | 573 |
| 119Ac-LTF$r8AYWAQL$SWA-NH₂ | 119 | | 1788.96 | 895.21 | 1789.97 | 895.49 | 597.33 |
| 120Ac-LTF$r8AYWAQL$SWA-NH₂ | 120 | iso2 | 1788.96 | 895.28 | 1789.97 | 895.49 | 597.33 |
| 121Ac-LTF$r8AYWAQL$SVS-NH₂ | 121 | | 1717.94 | 859.84 | 1718.95 | 859.98 | 573.65 |
| 122Ac-LTF$r8AYWAQL$SAS-NH₂ | 122 | | 1689.91 | 845.85 | 1690.92 | 845.96 | 564.31 |
| 123Ac-LTF$r8AYWAQL$SVG-NH₂ | 123 | | 1687.93 | 844.81 | 1688.94 | 844.97 | 563.65 |
| 124Ac-ETF$r8VYWAQL$SAa-NH₂ | 124 | | 1717.91 | 859.76 | 1718.92 | 859.96 | 573.64 |
| 125Ac-ETF$r8VYWAQL$SAA-NH₂ | 125 | | 1717.91 | 859.84 | 1718.92 | 859.96 | 573.64 |
| 126Ac-ETF$r8VYWAQL$SVA-NH₂ | 126 | | 1745.94 | 873.82 | 1746.95 | 873.98 | 582.99 |
| 127Ac-ETF$r8VYWAQL$SLA-NH₂ | 127 | | 1759.96 | 880.85 | 1760.97 | 880.99 | 587.66 |
| 128Ac-ETF$r8VYWAQL$SWA-NH₂ | 128 | | 1832.95 | 917.34 | 1833.96 | 917.48 | 611.99 |
| 129Ac-ETF$r8KYWAQL$SWA-NH₂ | 129 | | 1861.98 | 931.92 | 1862.99 | 932 | 621.67 |
| 130Ac-ETF$r8VYWAQL$SVS-NH₂ | 130 | | 1761.93 | 881.89 | 1762.94 | 881.97 | 588.32 |
| 131Ac-ETF$r8VYWAQL$SAS-NH₂ | 131 | | 1733.9 | 867.83 | 1734.91 | 867.96 | 578.97 |
| 132Ac-ETF$r8VYWAQL$SVG-NH₂ | 132 | | 1731.92 | 866.87 | 1732.93 | 866.97 | 578.31 |
| 133Ac-LTF$r8VYWAQL$SSa-NH₂ | 133 | | 1717.94 | 859.47 | 1718.95 | 859.98 | 573.65 |
| 134Ac-ETF$r8VYWAQL$SSa-NH₂ | 134 | | 1733.9 | 867.83 | 1734.91 | 867.96 | 578.97 |
| 135Ac-LTF$r8VYWAQL$SNa-NH₂ | 135 | | 1744.96 | 873.38 | 1745.97 | 873.49 | 582.66 |
| 136Ac-ETF$r8VYWAQL$SNa-NH₂ | 136 | | 1760.91 | 881.3 | 1761.92 | 881.46 | 587.98 |
| 137Ac-LTF$r8VYWAQL$SAa-NH₂ | 137 | | 1701.95 | 851.84 | 1702.96 | 851.98 | 568.32 |
| 138Ac-LTF$r8VYWAQL$SVA-NH₂ | 138 | | 1729.98 | 865.53 | 1730.99 | 866 | 577.67 |
| 139Ac-LTF$r8VYWAQL$SVA-NH₂ | 139 | iso2 | 1729.98 | 865.9 | 1730.99 | 866 | 577.67 |
| 140Ac-LTF$r8VYWAQL$SWA-NH₂ | 140 | | 1816.99 | 909.42 | 1818 | 909.5 | 606.67 |
| 141Ac-LTF$r8VYWAQL$SVS-NH₂ | 141 | | 1745.98 | 873.9 | 1746.99 | 874 | 583 |
| 142Ac-LTF$r8VYWAQL$SVS-NH₂ | 142 | iso2 | 1745.98 | 873.9 | 1746.99 | 874 | 583 |
| 143Ac-LTF$r8VYWAQL$SAS-NH₂ | 143 | | 1717.94 | 859.84 | 1718.95 | 859.98 | 573.65 |
| 144Ac-LTF$r8VYWAQL$SAS-NH₂ | 144 | iso2 | 1717.94 | 859.91 | 1718.95 | 859.98 | 573.65 |
| 145Ac-LTF$r8VYWAQL$SVG-NH₂ | 145 | | 1715.97 | 858.87 | 1716.98 | 858.99 | 573 |
| 146Ac-LTF$r8VYWAQL$SVG-NH₂ | 146 | iso2 | 1715.97 | 858.87 | 1716.98 | 858.99 | 573 |
| 147Ac-LTF$r8EYWAQCha$SAA-NH₂ | 147 | | 1771.96 | 886.85 | 1772.97 | 886.99 | 591.66 |
| 148Ac-LTF$r8EYWAQCha$SAA-NH₂ | 148 | iso2 | 1771.96 | 886.85 | 1772.97 | 886.99 | 591.66 |

TABLE 1-continued

| SP Sequence | SEQ ID NO: | Isomer | Exact Mass | Found Mass | Calc (M+1)/1 | Calc (M+2)/2 | Calc (m+3)/3 |
|---|---|---|---|---|---|---|---|
| 149Ac-LTF$r8EYWAQCpg$SAA-NH$_2$ | 149 | | 1743.92 | 872.86 | 1744.93 | 872.97 | 582.31 |
| 150Ac-LTF$r8EYWAQCpg$SAA-NH$_2$ | 150 | iso2 | 1743.92 | 872.86 | 1744.93 | 872.97 | 582.31 |
| 151Ac-LTF$r8EYWAQF$SAA-NH$_2$ | 151 | | 1765.91 | 883.44 | 1766.92 | 883.96 | 589.64 |
| 152Ac-LTF$r8EYWAQF$SAA-NH$_2$ | 152 | iso2 | 1765.91 | 883.89 | 1766.92 | 883.96 | 589.64 |
| 153Ac-LTF$r8EYWAQCba$SAA-NH$_2$ | 153 | | 1743.92 | 872.42 | 1744.93 | 872.97 | 582.31 |
| 154Ac-LTF$r8EYWAQCba$SAA-NH$_2$ | 154 | iso2 | 1743.92 | 873.39 | 1744.93 | 872.97 | 582.31 |
| 155Ac-LTF3C1$r8EYWAQL$SAA-NH$_2$ | 155 | | 1765.89 | 883.89 | 1766.9 | 883.95 | 589.64 |
| 156Ac-LTF3C1$r8EYWAQL$SAA-NH$_2$ | 156 | iso2 | 1765.89 | 883.96 | 1766.9 | 883.95 | 589.64 |
| 157Ac-LTF34F2$r8EYWAQL$SAA-NH$_2$ | 157 | | 1767.91 | 884.48 | 1768.92 | 884.96 | 590.31 |
| 158Ac-LTF34F2$r8EYWAQL$SAA-NH$_2$ | 158 | iso2 | 1767.91 | 884.48 | 1768.92 | 884.96 | 590.31 |
| 159Ac-LTF34F2$r8EYWAQhL$SAA-NH$_2$ | 159 | | 1781.92 | 891.44 | 1782.93 | 891.97 | 594.98 |
| 160Ac-LTF34F2$r8EYWAQhL$SAA-NH$_2$ | 160 | iso2 | 1781.92 | 891.88 | 1782.93 | 891.97 | 594.98 |
| 161Ac-ETF$r8EYWAQL$SAA-NH$_2$ | 161 | | 1747.88 | 874.34 | 1748.89 | 874.95 | 583.63 |
| 162Ac-LTF$r8AYWVQL$SAA-NH$_2$ | 162 | | 1701.95 | 851.4 | 1702.96 | 851.98 | 568.32 |
| 163Ac-LTF$r8AHWAQL$SAA-NH$_2$ | 163 | | 1647.91 | 824.83 | 1648.92 | 824.96 | 550.31 |
| 164Ac-LTF$r8AEWAQL$SAA-NH$_2$ | 164 | | 1639.9 | 820.39 | 1640.91 | 820.96 | 547.64 |
| 165Ac-LTF$r8ASWAQL$SAA-NH$_2$ | 165 | | 1597.89 | 799.38 | 1598.9 | 799.95 | 533.64 |
| 166Ac-LTF$r8AEWAQL$SAA-NH$_2$ | 166 | iso2 | 1639.9 | 820.39 | 1640.91 | 820.96 | 547.64 |
| 167Ac-LTF$r8ASWAQL$SAA-NH$_2$ | 167 | iso2 | 1597.89 | 800.31 | 1598.9 | 799.95 | 533.64 |
| 168Ac-LTF$r8AF4coohWAQL$SAA-NH$_2$ | 168 | | 1701.91 | 851.4 | 1702.92 | 851.96 | 568.31 |
| 169Ac-LTF$r8AF4coohWAQL$SAA-NH$_2$ | 169 | iso2 | 1701.91 | 851.4 | 1702.92 | 851.96 | 568.31 |
| 170Ac-LTF$r8AHWAQL$AAIa-NH$_2$ | 170 | | 1745 | 874.13 | 1746.01 | 873.51 | 582.67 |
| 171Ac-ITF$r8FYWAQL$AAIa-NH$_2$ | 171 | | 1847.04 | 923.92 | 1848.05 | 924.53 | 616.69 |
| 172Ac-ITF$r8EHWAQL$AAIa-NH$_2$ | 172 | | 1803.01 | 903.17 | 1804.02 | 902.51 | 602.01 |
| 173Ac-ITF$r8EHWAQL$AAIa-NH$_2$ | 173 | iso2 | 1803.01 | 903.17 | 1804.02 | 902.51 | 602.01 |
| 174Ac-ETF$r8EHWAQL$AAIa-NH$_2$ | 174 | | 1818.97 | 910.76 | 1819.98 | 910.49 | 607.33 |
| 175Ac-ETF$r8EHWAQL$AAIa-NH$_2$ | 175 | iso2 | 1818.97 | 910.85 | 1819.98 | 910.49 | 607.33 |
| 176Ac-LTF$r8AHWVQL$AAIa-NH$_2$ | 176 | | 1773.03 | 888.09 | 1774.04 | 887.52 | 592.02 |
| 177Ac-ITF$r8FYWVQL$AAIa-NH$_2$ | 177 | | 1875.07 | 939.16 | 1876.08 | 938.54 | 626.03 |
| 178Ac-ITF$r8EYWVQL$AAIa-NH$_2$ | 178 | | 1857.04 | 929.83 | 1858.05 | 929.53 | 620.02 |
| 179Ac-ITF$r8EHWVQL$AAIa-NH$_2$ | 179 | | 1831.04 | 916.86 | 1832.05 | 916.53 | 611.35 |
| 180Ac-LTF$r8AEWAQL$AAIa-NH$_2$ | 180 | | 1736.99 | 869.87 | 1738 | 869.5 | 580 |
| 181Ac-LTF$r8AF4coohWAQL$AAIa-NH$_2$ | 181 | | 1799 | 900.17 | 1800.01 | 900.51 | 600.67 |
| 182Ac-LTF$r8AF4coohWAQL$AAIa-NH$_2$ | 182 | iso2 | 1799 | 900.24 | 1800.01 | 900.51 | 600.67 |
| 183Ac-LTF$r8AHWAQL$AHFA-NH$_2$ | 183 | | 1845.01 | 923.89 | 1846.02 | 923.51 | 616.01 |
| 184Ac-ITF$r8FYWAQL$AHFA-NH$_2$ | 184 | | 1947.05 | 975.05 | 1948.06 | 974.53 | 650.02 |
| 185Ac-ITF$r8FYWAQL$AHFA-NH$_2$ | 185 | iso2 | 1947.05 | 976.07 | 1948.06 | 974.53 | 650.02 |
| 186Ac-ITF$r8FHWAQL$AEFA-NH$_2$ | 186 | | 1913.02 | 958.12 | 1914.03 | 957.52 | 638.68 |

TABLE 1-continued

| SP Sequence | SEQ ID NO: | Isomer | Exact Mass | Found Mass | Calc (M+1)/1 | Calc (M+2)/2 | Calc (m+3)/3 |
|---|---|---|---|---|---|---|---|
| 187Ac-ITF$r8FHWAQL$AEFA-NH$_2$ | 187 | iso2 | 1913.02 | 957.86 | 1914.03 | 957.52 | 638.68 |
| 188Ac-ITF$r8EHWAQL$AHFA-NH$_2$ | 188 | | 1903.01 | 952.94 | 1904.02 | 952.51 | 635.34 |
| 189Ac-ITF$r8EHWAQL$AHFA-NH$_2$ | 189 | iso2 | 1903.01 | 953.87 | 1904.02 | 952.51 | 635.34 |
| 190Ac-LTF$r8AHWVQL$AHFA-NH$_2$ | 190 | | 1873.04 | 937.86 | 1874.05 | 937.53 | 625.35 |
| 191Ac-ITF$r8FYWVQL$AHFA-NH$_2$ | 191 | | 1975.08 | 988.83 | 1976.09 | 988.55 | 659.37 |
| 192Ac-ITF$r8EYWVQL$AHFA-NH$_2$ | 192 | | 1957.05 | 979.35 | 1958.06 | 979.53 | 653.36 |
| 193Ac-ITF$r8EHWVQL$AHFA-NH$_2$ | 193 | | 1931.05 | 967 | 1932.06 | 966.53 | 644.69 |
| 194Ac-ITF$r8EHWVQL$AHFA-NH$_2$ | 194 | iso2 | 1931.05 | 967.93 | 1932.06 | 966.53 | 644.69 |
| 195Ac-ETF$r8EYWAAL$SAA-NH$_2$ | 195 | | 1690.86 | 845.85 | 1691.87 | 846.44 | 564.63 |
| 196Ac-LTF$r8AYWVAL$SAA-NH$_2$ | 196 | | 1644.93 | 824.08 | 1645.94 | 823.47 | 549.32 |
| 197Ac-LTF$r8AHWAAL$SAA-NH$_2$ | 197 | | 1590.89 | 796.88 | 1591.9 | 796.45 | 531.3 |
| 198Ac-LTF$r8AEWAAL$SAA-NH$_2$ | 198 | | 1582.88 | 791.9 | 1583.89 | 792.45 | 528.63 |
| 199Ac-LTF$r8AEWAAL$SAA-NH$_2$ | 199 | iso2 | 1582.88 | 791.9 | 1583.89 | 792.45 | 528.63 |
| 200Ac-LTF$r8ASWAAL$SAA-NH$_2$ | 200 | | 1540.87 | 770.74 | 1541.88 | 771.44 | 514.63 |
| 201Ac-LTF$r8ASWAAL$SAA-NH$_2$ | 201 | iso2 | 1540.87 | 770.88 | 1541.88 | 771.44 | 514.63 |
| 202Ac-LTF$r8AYWAAL$AAIa-NH$_2$ | 202 | | 1713.99 | 857.39 | 1715 | 858 | 572.34 |
| 203Ac-LTF$r8AYWAAL$AAIa-NH$_2$ | 203 | iso2 | 1713.99 | 857.84 | 1715 | 858 | 572.34 |
| 204Ac-LTF$r8AYWAAL$AHFA-NH$_2$ | 204 | | 1813.99 | 907.86 | 1815 | 908 | 605.67 |
| 205Ac-LTF$r8EHWAQL$AHIa-NH$_2$ | 205 | | 1869.03 | 936.1 | 1870.04 | 935.52 | 624.02 |
| 206Ac-LTF$r8EHWAQL$AHIa-NH$_2$ | 206 | iso2 | 1869.03 | 937.03 | 1870.04 | 935.52 | 624.02 |
| 207Ac-LTF$r8AHWAQL$AHIa-NH$_2$ | 207 | | 1811.03 | 906.87 | 1812.04 | 906.52 | 604.68 |
| 208Ac-LTF$r8EYWAQL$AHIa-NH$_2$ | 208 | | 1895.04 | 949.15 | 1896.05 | 948.53 | 632.69 |
| 209Ac-LTF$r8AYWAQL$AAFa-NH$_2$ | 209 | | 1804.99 | 903.2 | 1806 | 903.5 | 602.67 |
| 210Ac-LTF$r8AYWAQL$AAFa-NH$_2$ | 210 | iso2 | 1804.99 | 903.28 | 1806 | 903.5 | 602.67 |
| 211Ac-LTF$r8AYWAQL$AAWa-NH$_2$ | 211 | | 1844 | 922.81 | 1845.01 | 923.01 | 615.67 |
| 212Ac-LTF$r8AYWAQL$AAVa-NH$_2$ | 212 | | 1756.99 | 878.86 | 1758 | 879.5 | 586.67 |
| 213Ac-LTF$r8AYWAQL$AAVa-NH$_2$ | 213 | iso2 | 1756.99 | 879.3 | 1758 | 879.5 | 586.67 |
| 214Ac-LTF$r8AYWAQL$AALa-NH$_2$ | 214 | | 1771.01 | 886.26 | 1772.02 | 886.51 | 591.34 |
| 215Ac-LTF$r8AYWAQL$AALa-NH$_2$ | 215 | iso2 | 1771.01 | 886.33 | 1772.02 | 886.51 | 591.34 |
| 216Ac-LTF$r8EYWAQL$AAIa-NH$_2$ | 216 | | 1829.01 | 914.89 | 1830.02 | 915.51 | 610.68 |
| 217Ac-LTF$r8EYWAQL$AAIa-NH$_2$ | 217 | iso2 | 1829.01 | 915.34 | 1830.02 | 915.51 | 610.68 |
| 218Ac-LTF$r8EYWAQL$AAFa-NH$_2$ | 218 | | 1863 | 932.87 | 1864.01 | 932.51 | 622.01 |
| 219Ac-LTF$r8EYWAQL$AAFa-NH$_2$ | 219 | iso2 | 1863 | 932.87 | 1864.01 | 932.51 | 622.01 |
| 220Ac-LTF$r8EYWAQL$AAVa-NH$_2$ | 220 | | 1815 | 908.23 | 1816.01 | 908.51 | 606.01 |
| 221Ac-LTF$r8EYWAQL$AAVa-NH$_2$ | 221 | iso2 | 1815 | 908.31 | 1816.01 | 908.51 | 606.01 |
| 222Ac-LTF$r8EHWAQL$AAIa-NH$_2$ | 222 | | 1803.01 | 903.17 | 1804.02 | 902.51 | 602.01 |
| 223Ac-LTF$r8EHWAQL$AAIa-NH$_2$ | 223 | iso2 | 1803.01 | 902.8 | 1804.02 | 902.51 | 602.01 |
| 224Ac-LTF$r8EHWAQL$AAWa-NH$_2$ | 224 | | 1876 | 939.34 | 1877.01 | 939.01 | 626.34 |

TABLE 1-continued

| SP Sequence | SEQ ID NO: | Isomer | Exact Mass | Found Mass | Calc (M+1)/1 | Calc (M+2)/2 | Calc (m+3)/3 |
|---|---|---|---|---|---|---|---|
| 225 Ac-LTF$r8EHWAQL$AAWa-NH₂ | 225 | iso2 | 1876 | 939.62 | 1877.01 | 939.01 | 626.34 |
| 226 Ac-LTF$r8EHWAQL$AALa-NH₂ | 226 | | 1803.01 | 902.8 | 1804.02 | 902.51 | 602.01 |
| 227 Ac-LTF$r8EHWAQL$AALa-NH₂ | 227 | iso2 | 1803.01 | 902.9 | 1804.02 | 902.51 | 602.01 |
| 228 Ac-ETF$r8EHWVQL$AALa-NH₂ | 228 | | 1847 | 924.82 | 1848.01 | 924.51 | 616.67 |
| 229 Ac-LTF$r8AYWAQL$AAAa-NH₂ | 229 | | 1728.96 | 865.89 | 1729.97 | 865.49 | 577.33 |
| 230 Ac-LTF$r8AYWAQL$AAAa-NH₂ | 230 | iso2 | 1728.96 | 865.89 | 1729.97 | 865.49 | 577.33 |
| 231 Ac-LTF$r8AYWAQL$AAAibA-NH₂ | 231 | | 1742.98 | 872.83 | 1743.99 | 872.5 | 582 |
| 232 Ac-LTF$r8AYWAQL$AAAibA-NH₂ | 232 | iso2 | 1742.98 | 872.92 | 1743.99 | 872.5 | 582 |
| 233 Ac-LTF$r8AYWAQL$AAAAa-NH₂ | 233 | | 1800 | 901.42 | 1801.01 | 901.01 | 601.01 |
| 234 Ac-LTF$r5AYWAQL$s8AAIa-NH₂ | 234 | | 1771.01 | 887.17 | 1772.02 | 886.51 | 591.34 |
| 235 Ac-LTF$r5AYWAQL$s8SAA-NH₂ | 235 | | 1673.92 | 838.33 | 1674.93 | 837.97 | 558.98 |
| 236 Ac-LTF$r8AYWAQCba$AANleA-NH₂ | 236 | | 1783.01 | 892.64 | 1784.02 | 892.51 | 595.34 |
| 237 Ac-ETF$r8AYWAQCba$AANleA-NH₂ | 237 | | 1798.97 | 900.59 | 1799.98 | 900.49 | 600.66 |
| 238 Ac-LTF$r8EYWAQCba$AANleA-NH₂ | 238 | | 1841.01 | 922.05 | 1842.02 | 921.51 | 614.68 |
| 239 Ac-LTF$r8AYWAQCba$AWNleA-NH₂ | 239 | | 1898.05 | 950.46 | 1899.06 | 950.03 | 633.69 |
| 240 Ac-ETF$r8AYWAQCba$AWNleA-NH₂ | 240 | | 1914.01 | 958.11 | 1915.02 | 958.01 | 639.01 |
| 241 Ac-LTF$r8EYWAQCba$AWNleA-NH₂ | 241 | | 1956.06 | 950.62 | 1957.07 | 979.04 | 653.03 |
| 242 Ac-LTF$r8EYWAQCba$SAFA-NH₂ | 242 | | 1890.99 | 946.55 | 1892 | 946.5 | 631.34 |
| 243 Ac-LTF34F2$r8EYWAQCba$SANleA-NH₂ | 243 | | 1892.99 | 947.57 | 1894 | 947.5 | 632 |
| 244 Ac-LTF$r8EF4coohWAQCba$SANleA-NH₂ | 244 | | 1885 | 943.59 | 1886.01 | 943.51 | 629.34 |
| 245 Ac-LTF$r8EYWSQCba$SANleA-NH₂ | 245 | | 1873 | 937.58 | 1874.01 | 937.51 | 625.34 |
| 246 Ac-LTF$r8EYWWQCba$SANleA-NH₂ | 246 | | 1972.05 | 987.61 | 1973.06 | 987.03 | 658.36 |
| 247 Ac-LTF$r8EYWAQCba$AAIa-NH₂ | 247 | | 1841.01 | 922.05 | 1842.02 | 921.51 | 614.68 |
| 248 Ac-LTF34F2$r8EYWAQCba$AAIa-NH₂ | 248 | | 1876.99 | 939.99 | 1878 | 939.5 | 626.67 |
| 249 Ac-LTF$r8EF4coohWAQCba$AAIa-NH₂ | 249 | | 1869.01 | 935.64 | 1870.02 | 935.51 | 624.01 |
| 250 Pam-ETF$r8EYWAQCba$SAA-NH₂ | 250 | | 1956.1 | 979.57 | 1957.11 | 979.06 | 653.04 |
| 251 Ac-LThF$r8EFWAQCba$SAA-NH₂ | 251 | | 1741.94 | 872.11 | 1742.95 | 871.98 | 581.65 |
| 252 Ac-LTA$r8EYWAQCba$SAA-NH₂ | 252 | | 1667.89 | 835.4 | 1668.9 | 834.95 | 556.97 |
| 253 Ac-LTF$r8EYAAQCba$SAA-NH₂ | 253 | | 1628.88 | 815.61 | 1629.89 | 815.45 | 543.97 |
| 254 Ac-LTF$r8EY2NalAQCba$SAA-NH₂ | 254 | | 1754.93 | 879.04 | 1755.94 | 878.47 | 585.98 |
| 255 Ac-LTF$r8AYWAQCba$SAA-NH₂ | 255 | | 1685.92 | 844.71 | 1686.93 | 843.97 | 562.98 |
| 256 Ac-LTF$r8EYWAQCba$SAF-NH₂ | 256 | | 1819.96 | 911.41 | 1820.97 | 910.99 | 607.66 |
| 257 Ac-LTF$r8EYWAQCba$SAFa-NH₂ | 257 | | 1890.99 | 947.41 | 1892 | 946.5 | 631.34 |
| 258 Ac-LTF$r8AYWAQCba$SAF-NH₂ | 258 | | 1761.95 | 882.73 | 1762.96 | 881.98 | 588.32 |
| 259 Ac-LTF34F2$r8AYWAQCba$SAF-NH₂ | 259 | | 1797.93 | 900.87 | 1798.94 | 899.97 | 600.32 |
| 260 Ac-LTF$r8AF4coohWAQCba$SAF-NH₂ | 260 | | 1789.94 | 896.43 | 1790.95 | 895.98 | 597.65 |
| 261 Ac-LTF$r8EY6clWAQCba$SAF-NH₂ | 261 | | 1853.92 | 929.27 | 1854.93 | 927.97 | 618.98 |
| 262 Ac-LTF$r8AYWSQCba$SAF-NH₂ | 262 | | 1777.94 | 890.87 | 1778.95 | 889.98 | 593.65 |

TABLE 1-continued

| SP Sequence | SEQ ID NO: | Isomer | Exact Mass | Found Mass | Calc (M+1)/1 | Calc (M+2)/2 | Calc (m+3)/3 |
|---|---|---|---|---|---|---|---|
| 263 Ac-LTF$r8AYWWQCba$SAF-NH$_2$ | 263 | | 1876.99 | 939.91 | 1878 | 939.5 | 626.67 |
| 264 Ac-LTF$r8AYWAQCba$AAIa-NH$_2$ | 264 | | 1783.01 | 893.19 | 1784.02 | 892.51 | 595.34 |
| 265 Ac-LTF34F2$r8AYWAQCba$AAIa-NH$_2$ | 265 | | 1818.99 | 911.23 | 1820 | 910.5 | 607.34 |
| 266 Ac-LTF$r8AY6clWAQCba$AAIa-NH$_2$ | 266 | | 1816.97 | 909.84 | 1817.98 | 909.49 | 606.66 |
| 267 Ac-LTF$r8AF4coohWAQCba$AAIa-NH$_2$ | 267 | | 1811 | 906.88 | 1812.01 | 906.51 | 604.67 |
| 268 Ac-LTF$r8EYWAQCba$AAFa-NH$_2$ | 268 | | 1875 | 938.6 | 1876.01 | 938.51 | 626.01 |
| 269 Ac-LTF$r8EYWAQCba$AAFa-NH$_2$ | 269 | iso2 | 1875 | 938.6 | 1876.01 | 938.51 | 626.01 |
| 270 Ac-ETF$r8AYWAQCba$AWNlea-NH$_2$ | 270 | | 1914.01 | 958.42 | 1915.02 | 958.01 | 639.01 |
| 271 Ac-LTF$r8EYWAQCba$AWNlea-NH$_2$ | 271 | | 1956.06 | 979.42 | 1957.07 | 979.04 | 653.03 |
| 272 Ac-ETF$r8EYWAQCba$AWNlea-NH$_2$ | 272 | | 1972.01 | 987.06 | 1973.02 | 987.01 | 658.34 |
| 273 Ac-ETF$r8EYWAQCba$AWNlea-NH$_2$ | 273 | iso2 | 1972.01 | 987.06 | 1973.02 | 987.01 | 658.34 |
| 274 Ac-LTF$r8AYWAQCba$SAFa-NH$_2$ | 274 | | 1832.99 | 917.89 | 1834 | 917.5 | 612 |
| 275 Ac-LTF$r8AYWAQCba$SAFa-NH$_2$ | 275 | iso2 | 1832.99 | 918.07 | 1834 | 917.5 | 612 |
| 276 Ac-ETF$r8AYWAQL$AWNlea-NH$_2$ | 276 | | 1902.01 | 952.22 | 1903.02 | 952.01 | 635.01 |
| 277 Ac-LTF$r8EYWAQL$AWNlea-NH$_2$ | 277 | | 1944.06 | 973.5 | 1945.07 | 973.04 | 649.03 |
| 278 Ac-ETF$r8EYWAQL$AWNlea-NH$_2$ | 278 | | 1960.01 | 981.46 | 1961.02 | 981.01 | 654.34 |
| 279 Dmaac-LTF$r8EYWAQhL$SAA-NH$_2$ | 279 | | 1788.98 | 896.06 | 1789.99 | 895.5 | 597.33 |
| 280 Hexac-LTF$r8EYWAQhL$SAA-NH$_2$ | 280 | | 1802 | 902.9 | 1803.01 | 902.01 | 601.67 |
| 281 Napac-LTF$r8EYWAQhL$SAA-NH$_2$ | 281 | | 1871.99 | 937.58 | 1873 | 937 | 625 |
| 282 Decac-LTF$r8EYWAQhL$SAA-NH$_2$ | 282 | | 1858.06 | 930.55 | 1859.07 | 930.04 | 620.36 |
| 283 Admac-LTF$r8EYWAQhL$SAA-NH$_2$ | 283 | | 1866.03 | 934.07 | 1867.04 | 934.02 | 623.02 |
| 284 Tmac-LTF$r8EYWAQhL$SAA-NH$_2$ | 284 | | 1787.99 | 895.41 | 1789 | 895 | 597 |
| 285 Pam-LTF$r8EYWAQhL$SAA-NH$_2$ | 285 | | 1942.16 | 972.08 | 1943.17 | 972.09 | 648.39 |
| 286 Ac-LTF$r8AYWAQCba$AANleA-NH$_2$ | 286 | iso2 | 1783.01 | 892.64 | 1784.02 | 892.51 | 595.34 |
| 287 Ac-LTF34F2$r8EYWAQCba$AAIa-NH$_2$ | 287 | iso2 | 1876.99 | 939.62 | 1878 | 939.5 | 626.67 |
| 288 Ac-LTF34F2$r8EYWAQCba$SAA-NH$_2$ | 288 | | 1779.91 | 892.07 | 1780.92 | 890.96 | 594.31 |
| 289 Ac-LTF34F2$r8EYWAQCba$SAA-NH$_2$ | 289 | iso2 | 1779.91 | 891.61 | 1780.92 | 890.96 | 594.31 |
| 290 Ac-LTF$r8EF4coohWAQCba$SAA-NH$_2$ | 290 | | 1771.92 | 887.54 | 1772.93 | 886.97 | 591.65 |
| 291 Ac-LTF$r8EF4coohWAQCba$SAA-NH$_2$ | 291 | iso2 | 1771.92 | 887.63 | 1772.93 | 886.97 | 591.65 |
| 292 Ac-LTF$r8EYWSQCba$SAA-NH$_2$ | 292 | | 1759.92 | 881.9 | 1760.93 | 880.97 | 587.65 |
| 293 Ac-LTF$r8EYWSQCba$SAA-NH$_2$ | 293 | iso2 | 1759.92 | 881.9 | 1760.93 | 880.97 | 587.65 |
| 294 Ac-LTF$r8EYWAQhL$SAA-NH$_2$ | 294 | | 1745.94 | 875.05 | 1746.95 | 873.98 | 582.99 |
| 295 Ac-LTF$r8AYWAQhL$SAF-NH$_2$ | 295 | | 1763.97 | 884.02 | 1764.98 | 882.99 | 589 |
| 296 Ac-LTF$r8AYWAQhL$SAF-NH$_2$ | 296 | iso2 | 1763.97 | 883.56 | 1764.98 | 882.99 | 589 |
| 297 Ac-LTF34F2$r8AYWAQhL$SAA-NH$_2$ | 297 | | 1723.92 | 863.67 | 1724.93 | 862.97 | 575.65 |
| 298 Ac-LTF34F2$r8AYWAQhL$SAA-NH$_2$ | 298 | iso2 | 1723.92 | 864.04 | 1724.93 | 862.97 | 575.65 |
| 299 Ac-LTF$r8AF4coohWAQhL$SAA-NH$_2$ | 299 | | 1715.93 | 859.44 | 1716.94 | 858.97 | 572.98 |
| 300 Ac-LTF$r8AF4coohWAQhL$SAA-NH$_2$ | 300 | iso2 | 1715.93 | 859.6 | 1716.94 | 858.97 | 572.98 |

TABLE 1-continued

| SP Sequence | SEQ ID NO: | Isomer | Exact Mass | Found Mass | Calc (M+1)/1 | Calc (M+2)/2 | Calc (m+3)/3 |
|---|---|---|---|---|---|---|---|
| 301 Ac-LTF$r8AYWSQhL$SAA-NH$_2$ | 301 | | 1703.93 | 853.96 | 1704.94 | 852.97 | 568.98 |
| 302 Ac-LTF$r8AYWSQhL$SAA-NH$_2$ | 302 | iso2 | 1703.93 | 853.59 | 1704.94 | 852.97 | 568.98 |
| 303 Ac-LTF$r8EYWAQL$AANleA-NH$_2$ | 303 | | 1829.01 | 915.45 | 1830.02 | 915.51 | 610.68 |
| 304 Ac-LTF34F2$r8AYWAQL$AANleA-NH$_2$ | 304 | | 1806.99 | 904.58 | 1808 | 904.5 | 603.34 |
| 305 Ac-LTF$r8AF4coohWAQL$AANleA-NH$_2$ | 305 | | 1799 | 901.6 | 1800.01 | 900.51 | 600.67 |
| 306 Ac-LTF$r8AYWSQL$AANleA-NH$_2$ | 306 | | 1787 | 894.75 | 1788.01 | 894.51 | 596.67 |
| 307 Ac-LTF34F2$r8AYWAQhL$AANleA-NH$_2$ | 307 | | 1821 | 911.79 | 1822.01 | 911.51 | 608.01 |
| 308 Ac-LTF34F2$r8AYWAQhL$AANleA-NH$_2$ | 308 | iso2 | 1821 | 912.61 | 1822.01 | 911.51 | 608.01 |
| 309 Ac-LTF$r8AF4coohWAQhL$AANleA-NH$_2$ | 309 | | 1813.02 | 907.95 | 1814.03 | 907.52 | 605.35 |
| 310 Ac-LTF$r8AF4coohWAQhL$AANleA-NH$_2$ | 310 | iso2 | 1813.02 | 908.54 | 1814.03 | 907.52 | 605.35 |
| 311 Ac-LTF$r8AYWSQhL$AANleA-NH$_2$ | 311 | | 1801.02 | 901.84 | 1802.03 | 901.52 | 601.35 |
| 312 Ac-LTF$r8AYWSQhL$AANleA-NH$_2$ | 312 | iso2 | 1801.02 | 902.62 | 1802.03 | 901.52 | 601.35 |
| 313 Ac-LTF$r8AYWAQhL$AAAAa-NH$_2$ | 313 | | 1814.01 | 908.63 | 1815.02 | 908.01 | 605.68 |
| 314 Ac-LTF$r8AYWAQhL$AAAAa-NH$_2$ | 314 | iso2 | 1814.01 | 908.34 | 1815.02 | 908.01 | 605.68 |
| 315 Ac-LTF$r8AYWAQL$AAAAAa-NH$_2$ | 315 | | 1871.04 | 936.94 | 1872.05 | 936.53 | 624.69 |
| 316 Ac-LTF$r8AYWAQL$AAAAAAa-NH$_2$ | 316 | iso2 | 1942.07 | 972.5 | 1943.08 | 972.04 | 648.37 |
| 317 Ac-LTF$r8AYWAQL$AAAAAAa-NH$_2$ | 317 | iso1 | 1942.07 | 972.5 | 1943.08 | 972.04 | 648.37 |
| 318 Ac-LTF$r8EYWAQhL$AANleA-NH$_2$ | 318 | | 1843.03 | 922.54 | 1844.04 | 922.52 | 615.35 |
| 319 Ac-AATF$r8AYWAQL$AANleA-NH$_2$ | 319 | | 1800 | 901.39 | 1801.01 | 901.01 | 601.01 |
| 320 Ac-LTF$r8AYWAQL$AANleAA-NH$_2$ | 320 | | 1842.04 | 922.45 | 1843.05 | 922.03 | 615.02 |
| 321 Ac-ALTF$r8AYWAQL$AANleAA-NH$_2$ | 321 | | 1913.08 | 957.94 | 1914.09 | 957.55 | 638.7 |
| 322 Ac-LTF$r8AYWAQCba$AANleAA-NH$_2$ | 322 | | 1854.04 | 928.43 | 1855.05 | 928.03 | 619.02 |
| 323 Ac-LTF$r8AYWAQhL$AANleAA-NH$_2$ | 323 | | 1856.06 | 929.4 | 1857.07 | 929.04 | 619.69 |
| 324 Ac-LTF$r8EYWAQCba$SAAA-NH$_2$ | 324 | | 1814.96 | 909.37 | 1815.97 | 908.49 | 605.99 |
| 325 Ac-LTF$r8EYWAQCba$SAAA-NH$_2$ | 325 | iso2 | 1814.96 | 909.37 | 1815.97 | 908.49 | 605.99 |
| 326 Ac-LTF$r8EYWAQCba$SAAAA-NH$_2$ | 326 | | 1886 | 944.61 | 1887.01 | 944.01 | 629.67 |
| 327 Ac-LTF$r8EYWAQCba$SAAAA-NH$_2$ | 327 | iso2 | 1886 | 944.61 | 1887.01 | 944.01 | 629.67 |
| 328 Ac-ALTF$r8EYWAQCba$SAA-NH$_2$ | 328 | | 1814.96 | 909.09 | 1815.97 | 908.49 | 605.99 |
| 329 Ac-ALTF$r8EYWAQCba$SAAA-NH$_2$ | 329 | | 1886 | 944.61 | 1887.01 | 944.01 | 629.67 |
| 330 Ac-ALTF$r8EYWAQCba$SAA-NH$_2$ | 330 | iso2 | 1814.96 | 909.09 | 1815.97 | 908.49 | 605.99 |
| 331 Ac-LTF$r8EYWAQL$AAAAAa-NH$_2$ | 331 | iso2 | 1929.04 | 966.08 | 1930.05 | 965.53 | 644.02 |
| 332 Ac-LTF$r8EY6clWAQCba$SAA-NH$_2$ | 332 | | 1777.89 | 890.78 | 1778.9 | 889.95 | 593.64 |
| 333 Ac-LTF$r8EF4cooh6clWAQCba$SANleA-NH$_2$ | 333 | | 1918.96 | 961.27 | 1919.97 | 960.49 | 640.66 |
| 334 Ac-LTF$r8EF4cooh6clWAQCba$SANleA-NH$_2$ | 334 | iso2 | 1918.96 | 961.27 | 1919.97 | 960.49 | 640.66 |
| 335 Ac-LTF$r8EF4cooh6clWAQCba$AAIa-NH$_2$ | 335 | | 1902.97 | 953.03 | 1903.98 | 952.49 | 635.33 |
| 336 Ac-LTF$r8EF4cooh6clWAQCba$AAIa-NH$_2$ | 336 | iso2 | 1902.97 | 953.13 | 1903.98 | 952.49 | 635.33 |
| 337 Ac-LTF$r8AY6clWAQL$AAAAAa-NH$_2$ | 337 | | 1905 | 954.61 | 1906.01 | 953.51 | 636.01 |

TABLE 1-continued

| SP Sequence | SEQ ID NO: | Isomer | Exact Mass | Found Mass | Calc (M+1)/1 | Calc (M+2)/2 | Calc (m+3)/3 |
|---|---|---|---|---|---|---|---|
| 338Ac-LTF$r8AY6clWAQL$AAAAAa-NH2 | 338 | iso2 | 1905 | 954.9 | 1906.01 | 953.51 | 636.01 |
| 339Ac-F$r8AY6clWEAL$AAAAAAa-NH2 | 339 | | 1762.89 | 883.01 | 1763.9 | 882.45 | 588.64 |
| 340Ac-ETF$r8EYWAQL$AAAAAa-NH2 | 340 | | 1945 | 974.31 | 1946.01 | 973.51 | 649.34 |
| 341Ac-ETF$r8EYWAQL$AAAAAa-NH2 | 341 | iso2 | 1945 | 974.49 | 1946.01 | 973.51 | 649.34 |
| 342Ac-LTF$r8EYWAQL$AAAAAAa-NH2 | 342 | | 2000.08 | 1001.6 | 2001.09 | 1001.05 | 667.7 |
| 343Ac-LTF$r8EYWAQL$AAAAAAa-NH2 | 343 | iso2 | 2000.08 | 1001.6 | 2001.09 | 1001.05 | 667.7 |
| 344Ac-LTF$r8AYWAQL$AANleAAa-NH2 | 344 | | 1913.08 | 958.58 | 1914.09 | 957.55 | 638.7 |
| 345Ac-LTF$r8AYWAQL$AANleAAa-NH2 | 345 | iso2 | 1913.08 | 958.58 | 1914.09 | 957.55 | 638.7 |
| 346Ac-LTF$r8EYWAQCba$AAAAAa-NH2 | 346 | | 1941.04 | 972.55 | 1942.05 | 971.53 | 648.02 |
| 347Ac-LTF$r8EYWAQCba$AAAAAa-NH2 | 347 | iso2 | 1941.04 | 972.55 | 1942.05 | 971.53 | 648.02 |
| 348Ac-LTF$r8EF4coohWAQCba$AAAAAa-NH2 | 348 | | 1969.04 | 986.33 | 1970.05 | 985.53 | 657.35 |
| 349Ac-LTF$r8EF4coohWAQCba$AAAAAa-NH2 | 349 | iso2 | 1969.04 | 986.06 | 1970.05 | 985.53 | 657.35 |
| 350Ac-LTF$r8EYWSQCba$AAAAAa-NH2 | 350 | | 1957.04 | 980.04 | 1958.05 | 979.53 | 653.35 |
| 351Ac-LTF$r8EYWSQCba$AAAAAa-NH2 | 351 | iso2 | 1957.04 | 980.04 | 1958.05 | 979.53 | 653.35 |
| 352Ac-LTF$r8EYWAQCba$SAAa-NH2 | 352 | | 1814.96 | 909 | 1815.97 | 908.49 | 605.99 |
| 353Ac-LTF$r8EYWAQCba$SAAa-NH2 | 353 | iso2 | 1814.96 | 909 | 1815.97 | 908.49 | 605.99 |
| 354Ac-ALTF$r8EYWAQCba$SAAa-NH2 | 354 | | 1886 | 944.52 | 1887.01 | 944.01 | 629.67 |
| 355Ac-ALTF$r8EYWAQCba$SAAa-NH2 | 355 | iso2 | 1886 | 944.98 | 1887.01 | 944.01 | 629.67 |
| 356Ac-ALTF$r8EYWAQCba$SAAAa-N$_{H2}$ | 356 | | 1957.04 | 980.04 | 1958.05 | 979.53 | 653.35 |
| 357Ac-ALTF$r8EYWAQCba$SAAAa-NH2 | 357 | iso2 | 1957.04 | 980.04 | 1958.05 | 979.53 | 653.35 |
| 358Ac-AALTF$r8EYWAQCba$SAAAa-NH2 | 358 | | 2028.07 | 1016.1 | 2029.08 | 1015.04 | 677.03 |
| 359Ac-AALTF$r8EYWAQCba$SAAAa-NH2 | 359 | iso2 | 2028.07 | 1015.57 | 2029.08 | 1015.04 | 677.03 |
| 360Ac-RTF$r8EYWAQCba$SAA-NH2 | 360 | | 1786.94 | 895.03 | 1787.95 | 894.48 | 596.65 |
| 361Ac-LRF$r8EYWAQCba$SAA-NH2 | 361 | | 1798.98 | 901.51 | 1799.99 | 900.5 | 600.67 |
| 362Ac-LTF$r8EYWRQCba$SAA-NH2 | 362 | | 1828.99 | 916.4 | 1830 | 915.5 | 610.67 |
| 363Ac-LTF$r8EYWARCba$SAA-NH2 | 363 | | 1771.97 | 887.63 | 1772.98 | 886.99 | 591.66 |
| 364Ac-LTF$r8EYWAQCba$RAA-NH2 | 364 | | 1812.99 | 908.08 | 1814 | 907.5 | 605.34 |
| 365Ac-LTF$r8EYWAQCba$SRA-NH2 | 365 | | 1828.99 | 916.12 | 1830 | 915.5 | 610.67 |
| 366Ac-LTF$r8EYWAQCba$SAR-NH2 | 366 | | 1828.99 | 916.12 | 1830 | 915.5 | 610.67 |
| 3675-FAM-BaLTF$r8EYWAQCba$SAA-NH2 | 367 | | 2131 | 1067.09 | 2132.01 | 1066.51 | 711.34 |
| 3685-FAM-BaLTF$r8AYWAQL$AANleA-NH2 | 368 | | 2158.08 | 1080.6 | 2159.09 | 1080.05 | 720.37 |
| 369Ac-LAF$r8EYWAQL$AANleA-NH2 | 369 | | 1799 | 901.05 | 1800.01 | 900.51 | 600.67 |
| 370Ac-ATF$r8EYWAQL$AANleA-NH2 | 370 | | 1786.97 | 895.03 | 1787.98 | 894.49 | 596.66 |
| 371Ac-AAF$r8EYWAQL$AANleA-NH2 | 371 | | 1756.96 | 880.05 | 1757.97 | 879.49 | 586.66 |
| 372Ac-AAAF$r8EYWAQL$AANleA-NH2 | 372 | | 1827.99 | 915.57 | 1829 | 915 | 610.34 |
| 373Ac-AAAAF$r8EYWAQL$AANleA-NH2 | 373 | | 1899.03 | 951.09 | 1900.04 | 950.52 | 634.02 |
| 374Ac-AATF$r8EYWAQL$AANleA-NH2 | 374 | | 1858 | 930.92 | 1859.01 | 930.01 | 620.34 |
| 375Ac-AALTF$r8EYWAQL$AANleA-NH2 | 375 | | 1971.09 | 987.17 | 1972.1 | 986.55 | 658.04 |

TABLE 1-continued

| SP Sequence | SEQ ID NO: | Isomer | Exact Mass | Found Mass | Calc (M+1)/1 | Calc (M+2)/2 | Calc (m+3)/3 |
|---|---|---|---|---|---|---|---|
| 376Ac-AAALTF$r8EYWAQL$AANleA-NH$_2$ | 376 | | 2042.12 | 1023.15 | 2043.13 | 1022.07 | 681.71 |
| 377Ac-LTF$r8EYWAQL$AANleAA-NH$_2$ | 377 | | 1900.05 | 952.02 | 1901.06 | 951.03 | 634.36 |
| 378Ac-ALTF$r8EYWAQL$AANleAA-NH$_2$ | 378 | | 1971.09 | 987.63 | 1972.1 | 986.55 | 658.04 |
| 379Ac-AALTF$r8EYWAQL$AANleAA-NH$_2$ | 379 | | 2042.12 | 1022.69 | 2043.13 | 1022.07 | 681.71 |
| 380Ac-LTF$r8EYWAQCba$AANleAA-NH$_2$ | 380 | | 1912.05 | 958.03 | 1913.06 | 957.03 | 638.36 |
| 381Ac-LTF$r8EYWAQhL$AANleAA-NH$_2$ | 381 | | 1914.07 | 958.68 | 1915.08 | 958.04 | 639.03 |
| 382Ac-ALTF$r8EYWAQhL$AANleAA-NH$_2$ | 382 | | 1985.1 | 994.1 | 1986.11 | 993.56 | 662.71 |
| 383Ac-LTF$r8ANmYWAQL$AANleA-NH$_2$ | 383 | | 1785.02 | 894.11 | 1786.03 | 893.52 | 596.01 |
| 384Ac-LTF$r8ANmYWAQL$AANleA-NH$_2$ | 384 | iso2 | 1785.02 | 894.11 | 1786.03 | 893.52 | 596.01 |
| 385Ac-LTF$r8AYNmWAQL$AANleA-NH$_2$ | 385 | | 1785.02 | 894.11 | 1786.03 | 893.52 | 596.01 |
| 386Ac-LTF$r8AYNmWAQL$AANleA-NH$_2$ | 386 | iso2 | 1785.02 | 894.11 | 1786.03 | 893.52 | 596.01 |
| 387Ac-LTF$r8AYAmwAQL$AANleA-NH$_2$ | 387 | | 1785.02 | 894.01 | 1786.03 | 893.52 | 596.01 |
| 388Ac-LTF$r8AYAmwAQL$AANleA-NH$_2$ | 388 | iso2 | 1785.02 | 894.01 | 1786.03 | 893.52 | 596.01 |
| 389Ac-LTF$r8AYWAibQL$AANleA-NH$_2$ | 389 | | 1785.02 | 894.01 | 1786.03 | 893.52 | 596.01 |
| 390Ac-LTF$r8AYWAibQL$AANleA-NH$_2$ | 390 | iso2 | 1785.02 | 894.01 | 1786.03 | 893.52 | 596.01 |
| 391Ac-LTF$r8AYWAQL$AAibNleA-NH$_2$ | 391 | | 1785.02 | 894.38 | 1786.03 | 893.52 | 596.01 |
| 392Ac-LTF$r8AYWAQL$AAibNleA-NH$_2$ | 392 | iso2 | 1785.02 | 894.38 | 1786.03 | 893.52 | 596.01 |
| 393Ac-LTF$r8AYWAQL$AaNleA-NH$_2$ | 393 | | 1771.01 | 887.54 | 1772.02 | 886.51 | 591.34 |
| 394Ac-LTF$r8AYWAQL$AaNleA-NH$_2$ | 394 | iso2 | 1771.01 | 887.54 | 1772.02 | 886.51 | 591.34 |
| 395Ac-LTF$r8AYWAQL$ASarNleA-NH$_2$ | 395 | | 1771.01 | 887.35 | 1772.02 | 886.51 | 591.34 |
| 396Ac-LTF$r8AYWAQL$ASarNleA-NH$_2$ | 396 | iso2 | 1771.01 | 887.35 | 1772.02 | 886.51 | 591.34 |
| 397Ac-LTF$r8AYWAQL$AANleAib-NH$_2$ | 397 | | 1785.02 | 894.75 | 1786.03 | 893.52 | 596.01 |
| 398Ac-LTF$r8AYWAQL$AANleAib-NH$_2$ | 398 | iso2 | 1785.02 | 894.75 | 1786.03 | 893.52 | 596.01 |
| 399Ac-LTF$r8AYWAQL$AANleNmA-NH$_2$ | 399 | | 1785.02 | 894.6 | 1786.03 | 893.52 | 596.01 |
| 400Ac-LTF$r8AYWAQL$AANleNmA-NH$_2$ | 400 | iso2 | 1785.02 | 894.6 | 1786.03 | 893.52 | 596.01 |
| 401Ac-LTF$r8AYWAQL$AANleSar-NH$_2$ | 401 | | 1771.01 | 886.98 | 1772.02 | 886.51 | 591.34 |
| 402Ac-LTF$r8AYWAQL$AANleSar-NH$_2$ | 402 | iso2 | 1771.01 | 886.98 | 1772.02 | 886.51 | 591.34 |
| 403Ac-LTF$r8AYWAQL$AANleAAib-NH$_2$ | 403 | | 1856.06 | | 1857.07 | 929.04 | 619.69 |
| 404Ac-LTF$r8AYWAQL$AANleAAib-NH$_2$ | 404 | iso2 | 1856.06 | | 1857.07 | 929.04 | 619.69 |
| 405Ac-LTF$r8AYWAQL$AANleANmA-NH$_2$ | 405 | | 1856.06 | 930.37 | 1857.07 | 929.04 | 619.69 |
| 406Ac-LTF$r8AYWAQL$AANleANmA-NH$_2$ | 406 | iso2 | 1856.06 | 930.37 | 1857.07 | 929.04 | 619.69 |
| 407Ac-LTF$r8AYWAQL$AANleAa-NH$_2$ | 407 | | 1842.04 | 922.69 | 1843.05 | 922.03 | 615.02 |
| 408Ac-LTF$r8AYWAQL$AANleAa-NH$_2$ | 408 | iso2 | 1842.04 | 922.69 | 1843.05 | 922.03 | 615.02 |
| 409Ac-LTF$r8AYWAQL$AANleASar-NH$_2$ | 409 | | 1842.04 | 922.6 | 1843.05 | 922.03 | 615.02 |
| 410Ac-LTF$r8AYWAQL$AANleASar-NH$_2$ | 410 | iso2 | 1842.04 | 922.6 | 1843.05 | 922.03 | 615.02 |
| 411Ac-LTF$/r8AYWAQLVAANleA-NH$_2$ | 411 | | 1799.04 | 901.14 | 1800.05 | 900.53 | 600.69 |
| 412Ac-LTFAibAYWAQLAibAANleA-NH$_2$ | 412 | | 1648.9 | 826.02 | 1649.91 | 825.46 | 550.64 |
| 413Ac-LTF$r8Cou4YWAQL$AANleA-NH$_2$ | 413 | | 1975.05 | 989.11 | 1976.06 | 988.53 | 659.36 |

TABLE 1-continued

| SP Sequence | SEQ ID NO: | Isomer | Exact Mass | Found Mass | Calc (M+1)/1 | Calc (M+2)/2 | Calc (m+3)/3 |
|---|---|---|---|---|---|---|---|
| 414 Ac-LTF$r8Cou4YWAQL$AANleA-NH₂ | 414 | iso2 | 1975.05 | 989.11 | 1976.06 | 988.53 | 659.36 |
| 415 Ac-LTF$r8AYWCou4QL$AANleA-NH₂ | 415 | | 1975.05 | 989.11 | 1976.06 | 988.53 | 659.36 |
| 416 Ac-LTF$r8AYWAQL$Cou4ANleA-NH₂ | 416 | | 1975.05 | 989.57 | 1976.06 | 988.53 | 659.36 |
| 417 Ac-LTF$r8AYWAQL$Cou4ANleA-NH₂ | 417 | iso2 | 1975.05 | 989.57 | 1976.06 | 988.53 | 659.36 |
| 418 Ac-LTF$r8AYWAQL$ACou4NleA-NH₂ | 418 | | 1975.05 | 989.57 | 1976.06 | 988.53 | 659.36 |
| 419 Ac-LTF$r8AYWAQL$ACou4NleA-NH₂ | 419 | iso2 | 1975.05 | 989.57 | 1976.06 | 988.53 | 659.36 |
| 420 Ac-LTF$r8AYWAQL$AANleA-OH | 420 | | 1771.99 | 887.63 | 1773 | 887 | 591.67 |
| 421 Ac-LTF$r8AYWAQL$AANleA-OH | 421 | iso2 | 1771.99 | 887.63 | 1773 | 887 | 591.67 |
| 422 Ac-LTF$r8AYWAQL$AANleA-NHnPr | 422 | | 1813.05 | 908.08 | 1814.06 | 907.53 | 605.36 |
| 423 Ac-LTF$r8AYWAQL$AANleA-NHnPr | 423 | iso2 | 1813.05 | 908.08 | 1814.06 | 907.53 | 605.36 |
| 424 Ac-LTF$r8AYWAQL$AANleA-NHnBu33Me | 424 | | 1855.1 | 929.17 | 1856.11 | 928.56 | 619.37 |
| 425 Ac-LTF$r8AYWAQL$AANleA-NHnBu33Me | 425 | iso2 | 1855.1 | 929.17 | 1856.11 | 928.56 | 619.37 |
| 426 Ac-LTF$r8AYWAQL$AANleA-NHHex | 426 | | 1855.1 | 929.17 | 1856.11 | 928.56 | 619.37 |
| 427 Ac-LTF$r8AYWAQL$AANleA-NHHex | 427 | iso2 | 1855.1 | 929.17 | 1856.11 | 928.56 | 619.37 |
| 428 Ac-LTA$r8AYWAQL$AANleA-NH₂ | 428 | | 1694.98 | 849.33 | 1695.99 | 848.5 | 566 |
| 429 Ac-LThL$r8AYWAQL$AANleA-NH₂ | 429 | | 1751.04 | 877.09 | 1752.05 | 876.53 | 584.69 |
| 430 Ac-LTF$r8AYAAQL$AANleA-NH2 | 430 | | 1655.97 | 829.54 | 1656.98 | 828.99 | 553 |
| 431 Ac-LTF$r8AY2NalAQL$AANleA-NH₂ | 431 | | 1782.01 | 892.63 | 1783.02 | 892.01 | 595.01 |
| 432 Ac-LTF$r8EYWCou4QCba$SAA-NH₂ | 432 | | 1947.97 | 975.8 | 1948.98 | 974.99 | 650.33 |
| 433 Ac-LTF$r8EYWCou7QCba$SAA-NH₂ | 433 | | 16.03 | 974.9 | 17.04 | 9.02 | 6.35 |
| 434 Ac-LTF%r8EYWAQCba%SAA-NH₂ | 434 | | 1745.94 | 874.8 | 1746.95 | 873.98 | 582.99 |
| 435 Dmaac-LTF$r8EYWAQCba$SAA-NH₂ | 435 | | 1786.97 | 894.8 | 1787.98 | 894.49 | 596.66 |
| 436 Dmaac-LTF$r8AYWAQL$AAAAAa-NH₂ | 436 | | 1914.08 | 958.2 | 1915.09 | 958.05 | 639.03 |
| 437 Dmaac-LTF$r8AYWAQL$AAAAAa-NH₂ | 437 | iso2 | 1914.08 | 958.2 | 1915.09 | 958.05 | 639.03 |
| 438 Dmaac-LTF$r8EYWAQL$AAAAAa-NH₂ | 438 | | 1972.08 | 987.3 | 1973.09 | 987.05 | 658.37 |
| 439 Dmaac-LTF$r8EYWAQL$AAAAAa-NH₂ | 439 | iso2 | 1972.08 | 987.3 | 1973.09 | 987.05 | 658.37 |
| 440 Dmaac-LTF$r8EF4coohWAQCba$AAIa-NH₂ | 440 | | 1912.05 | 957.4 | 1913.06 | 957.03 | 638.36 |
| 441 Dmaac-LTF$r8EF4coohWAQCba$AAIa-NH₂ | 441 | iso2 | 1912.05 | 957.4 | 1913.06 | 957.03 | 638.36 |
| 442 Dmaac-LTF$r8AYWAQL$AANleA-NH₂ | 442 | | 1814.05 | 908.3 | 1815.06 | 908.03 | 605.69 |
| 443 Dmaac-LTF$r8AYWAQL$AANleA-NH₂ | 443 | iso2 | 1814.05 | 908.3 | 1815.06 | 908.03 | 605.69 |
| 444 Ac-LTF%r8AYWAQL%AANleA-NH₂ | 444 | | 1773.02 | 888.37 | 1774.03 | 887.52 | 592.01 |
| 445 Ac-LTF%r8EYWAQL%AAAAAa-NH₂ | 445 | | 1931.06 | 966.4 | 1932.07 | 966.54 | 644.69 |
| 446 Cou6BaLTF$r8EYWAQhL$SAA-NH₂ | 446 | | 2018.05 | 1009.9 | 2019.06 | 1010.03 | 673.69 |
| 447 Cou8BaLTF$r8EYWAQhL$SAA-NH₂ | 447 | | 1962.96 | 982.34 | 1963.97 | 982.49 | 655.32 |
| 448 Ac-LTF4M8EYWAQL$AAAAAa-NH₂ | 448 | | 2054.93 | 1028.68 | 2055.94 | 1028.47 | 685.98 |
| 449 Ac-LTF$r8EYWAQL$AAAAAa-NH₂ | 449 | | 1929.04 | 966.17 | 1930.05 | 965.53 | 644.02 |
| 550 Ac-LTF$r8EYWAQL$AAAAAa-OH | 450 | | 1930.02 | 966.54 | 1931.03 | 966.02 | 644.35 |
| 551 Ac-LTF$r8EYWAQL$AAAAAa-OH | 451 | iso2 | 1930.02 | 965.89 | 1931.03 | 966.02 | 644.35 |

TABLE 1-continued

| SP Sequence | SEQ ID NO: | Isomer | Exact Mass | Found Mass | Calc (M+1)/1 | Calc (M+2)/2 | Calc (m+3)/3 |
|---|---|---|---|---|---|---|---|
| 552Ac-LTF$r8EYWAEL$AAAAAa-NH$_2$ | 452 | | 1930.02 | 966.82 | 1931.03 | 966.02 | 644.35 |
| 553Ac-LTF$r8EYWAEL$AAAAAa-NH$_2$ | 453 | iso2 | 1930.02 | 966.91 | 1931.03 | 966.02 | 644.35 |
| 554Ac-LTF$r8EYWAEL$AAAAAa-OH | 454 | | 1931.01 | 967.28 | 1932.02 | 966.51 | 644.68 |
| 555Ac-LTF$r8EY6clWAQL$AAAAAa-NH$_2$ | 455 | | 1963 | 983.28 | 1964.01 | 982.51 | 655.34 |
| 556Ac-LTF$r8EF4b0H2WAQL$AAAAAa-NH$_2$ | 456 | | 1957.05 | 980.04 | 1958.06 | 979.53 | 653.36 |
| 557Ac-AAALTF$r8EYWAQL$AAAAAa-NH$_2$ | 457 | | 2142.15 | 1072.83 | 2143.16 | 1072.08 | 715.06 |
| 558Ac-LTF34F2$r8EYWAQL$AAAAAa-NH$_2$ | 458 | | 1965.02 | 984.3 | 1966.03 | 983.52 | 656.01 |
| 559559Ac-RTF$r8EYWAQL$AAAAAa-NH$_2$ | 459 | | 1972.06 | 987.81 | 1973.07 | 987.04 | 658.36 |
| 560560Ac-LTA$r8EYWAQL$AAAAAa-NH$_2$ | 460 | | 1853.01 | 928.33 | 1854.02 | 927.51 | 618.68 |
| 561561Ac-LTF$r8EYWAibQL$AAAAAa-NH$_2$ | 461 | | 1943.06 | 973.48 | 1944.07 | 972.54 | 648.69 |
| 562562Ac-LTF$r8EYWAQL$AAibAAAa-NH$_2$ | 462 | | 1943.06 | 973.11 | 1944.07 | 972.54 | 648.69 |
| 563563Ac-LTF$r8EYWAQL$AAAibAAa-NH$_2$ | 463 | | 1943.06 | 973.48 | 1944.07 | 972.54 | 648.69 |
| 564564Ac-LTF$r8EYWAQL$AAAAibAa-NH$_2$ | 464 | | 1943.06 | 973.48 | 1944.07 | 972.54 | 648.69 |
| 565565Ac-LTF$r8EYWAQL$AAAAAiba-NH$_2$ | 465 | | 1943.06 | 973.38 | 1944.07 | 972.54 | 648.69 |
| 566566Ac-LTF$r8EYWAQL$AAAAAiba-NH$_2$ | 466 | iso2 | 1943.06 | 973.38 | 1944.07 | 972.54 | 648.69 |
| 567567Ac-LTF$r8EYWAQL$AAAAAAib-NH$_2$ | 467 | | 1943.06 | 973.01 | 1944.07 | 972.54 | 648.69 |
| 568568Ac-LTF$r8EYWAQL$AaAAAa-NH$_2$ | 468 | | 1929.04 | 966.54 | 1930.05 | 965.53 | 644.02 |
| 569569Ac-LTF$r8EYWAQL$AAaAAa-NH$_2$ | 469 | | 1929.04 | 966.35 | 1930.05 | 965.53 | 644.02 |
| 570570Ac-LTF$r8EYWAQL$AAAaAa-NH$_2$ | 470 | | 1929.04 | 966.54 | 1930.05 | 965.53 | 644.02 |
| 571571Ac-LTF$r8EYWAQL$AAAaAa-NH$_2$ | 471 | iso2 | 1929.04 | 966.35 | 1930.05 | 965.53 | 644.02 |
| 572572Ac-LTF$r8EYWAQL$AAAAaa-NH$_2$ | 472 | | 1929.04 | 966.35 | 1930.05 | 965.53 | 644.02 |
| 573573Ac-LTF$r8EYWAQL$AAAAAA-NH$_2$ | 473 | | 1929.04 | 966.35 | 1930.05 | 965.53 | 644.02 |
| 574574Ac-LTF$r8EYWAQL$ASarAAAa-NH$_2$ | 474 | | 1929.04 | 966.54 | 1930.05 | 965.53 | 644.02 |
| 575575Ac-LTF$r8EYWAQL$AASarAAa-NH$_2$ | 475 | | 1929.04 | 966.35 | 1930.05 | 965.53 | 644.02 |
| 576576Ac-LTF$r8EYWAQL$AAASarAa-NH$_2$ | 476 | | 1929.04 | 966.35 | 1930.05 | 965.53 | 644.02 |
| 577577Ac-LTF$r8EYWAQL$AAAASara-NH$_2$ | 477 | | 1929.04 | 966.35 | 1930.05 | 965.53 | 644.02 |
| 578578Ac-LTF$r8EYWAQL$AAAAASar-NH$_2$ | 478 | | 1929.04 | 966.08 | 1930.05 | 965.53 | 644.02 |
| 579579Ac-7LTF$r8EYWAQL$AAAAAa-NH$_2$ | 479 | | 1918.07 | 951.99 | 1919.08 | 960.04 | 640.37 |
| 581581Ac-TF$r8EYWAQL$AAAAAa-NH$_2$ | 480 | | 1815.96 | 929.85 | 1816.97 | 908.99 | 606.33 |
| 582582Ac-F$r8EYWAQL$AAAAAa-NH$_2$ | 481 | | 1714.91 | 930.92 | 1715.92 | 858.46 | 572.64 |
| 583583Ac-LVF$r8EYWAQL$AAAAAa-NH$_2$ | 482 | | 1927.06 | 895.12 | 1928.07 | 964.54 | 643.36 |
| 584584Ac-AAF$r8EYWAQL$AAAAAa-NH$_2$ | 483 | | 1856.98 | 859.51 | 1857.99 | 929.5 | 620 |
| 585585Ac-LTF$r8EYWAQL$AAAAa-NH$_2$ | 484 | | 1858 | 824.08 | 1859.01 | 930.01 | 620.34 |
| 586586Ac-LTF$r8EYWAQL$AAAa-NH$_2$ | 485 | | 1786.97 | 788.56 | 1787.98 | 894.49 | 596.66 |
| 587587Ac-LTF$r8EYWAQL$AAa-NH$_2$ | 486 | | 1715.93 | 1138.57 | 1716.94 | 858.97 | 572.98 |
| 588588Ac-LTF$r8EYWAQL$Aa-NH$_2$ | 487 | | 1644.89 | 1144.98 | 1645.9 | 823.45 | 549.3 |
| 589589Ac-LTF$r8EYWAQL$a-NH$_2$ | 488 | | 1573.85 | 1113.71 | 1574.86 | 787.93 | 525.62 |
| 590590Ac-LTF$r8EYWAQL$AAA-OH | 489 | | 1716.91 | 859.55 | 1717.92 | 859.46 | 573.31 |

TABLE 1-continued

| SP Sequence | SEQ ID NO: | Isomer | Exact Mass | Found Mass | Calc (M+1)/1 | Calc (M+2)/2 | Calc (m+3)/3 |
|---|---|---|---|---|---|---|---|
| 591 Ac-LTF$r8EYWAQL$A-OH | 490 | | 1574.84 | 975.14 | 1575.85 | 788.43 | 525.95 |
| 592 Ac-LTF$r8EYWAQL$AAA-NH₂ | 491 | | 1715.93 | 904.75 | 1716.94 | 858.97 | 572.98 |
| 593 Ac-LTF$r8EYWAQCba$SAA-OH | 492 | | 1744.91 | 802.49 | 1745.92 | 873.46 | 582.64 |
| 594 Ac-LTF$r8EYWAQCba$S-OH | 493 | | 1602.83 | 913.53 | 1603.84 | 802.42 | 535.28 |
| 595 Ac-LTF$r8EYWAQCba$S-NH₂ | 494 | | 1601.85 | 979.58 | 1602.86 | 801.93 | 534.96 |
| 596 4-FBz1-LTF$r8EYWAQL$AAAAAa-NH₂ | 495 | | 2009.05 | 970.52 | 2010.06 | 1005.53 | 670.69 |
| 597 4-FBz1-LTF$r8EYWAQCba$SAA-NH₂ | 496 | | 1823.93 | 965.8 | 1824.94 | 912.97 | 608.98 |
| 598 Ac-LTF$r8RYWAQL$AAAAAa-NH₂ | 497 | | 1956.1 | 988.28 | 1957.11 | 979.06 | 653.04 |
| 599 Ac-LTF$r8HYWAQL$AAAAAa-NH₂ | 498 | | 1937.06 | 1003.54 | 1938.07 | 969.54 | 646.69 |
| 600 Ac-LTF$r8QYWAQL$AAAAAa-NH₂ | 499 | | 1928.06 | 993.92 | 1929.07 | 965.04 | 643.69 |
| 601 Ac-LTF$r8CitYWAQL$AAAAAa-NH₂ | 500 | | 1957.08 | 987 | 1958.09 | 979.55 | 653.37 |
| 602 Ac-LTF$r8G1aYWAQL$AAAAAa-NH₂ | 501 | | 1973.03 | 983 | 1974.04 | 987.52 | 658.68 |
| 603 Ac-LTF$r8F4gYWAQL$AAAAAa-NH₂ | 502 | | 2004.1 | 937.86 | 2005.11 | 1003.06 | 669.04 |
| 604 Ac-LTF$r82mRYWAQL$AAAAAa-NH₂ | 503 | | 1984.13 | 958.58 | 1985.14 | 993.07 | 662.38 |
| 605 Ac-LTF$r8ipKYWAQL$AAAAAa-NH₂ | 504 | | 1970.14 | 944.52 | 1971.15 | 986.08 | 657.72 |
| 606 Ac-LTF$r8F4NH2YWAQL$AAAAAa-NH₂ | 505 | | 1962.08 | 946 | 1963.09 | 982.05 | 655.03 |
| 607 Ac-LTF$r8EYWAAL$AAAAAa-NH₂ | 506 | | 1872.02 | 959.32 | 1873.03 | 937.02 | 625.01 |
| 608 Ac-LTF$r8EYWALL$AAAAAa-NH₂ | 507 | | 1914.07 | 980.88 | 1915.08 | 958.04 | 639.03 |
| 609 Ac-LTF$r8EYWAAibL$AAAAAa-NH₂ | 508 | | 1886.03 | 970.61 | 1887.04 | 944.02 | 629.68 |
| 610 Ac-LTF$r8EYWASL$AAAAAa-NH₂ | 509 | | 1888.01 | 980.51 | 1889.02 | 945.01 | 630.34 |
| 611 Ac-LTF$r8EYWANL$AAAAAa-NH₂ | 510 | | 1915.02 | 1006.41 | 1916.03 | 958.52 | 639.35 |
| 612 Ac-LTF$r8EYWACitL$AAAAAa-NH₂ | 511 | | 1958.07 | | 1959.08 | 980.04 | 653.7 |
| 613 Ac-LTF$r8EYWAHL$AAAAAa-NH₂ | 512 | | 1938.04 | 966.24 | 1939.05 | 970.03 | 647.02 |
| 614 Ac-LTF$r8EYWARL$AAAAAa-NH₂ | 513 | | 1957.08 | | 1958.09 | 979.55 | 653.37 |
| 615 Ac-LTF$r8EpYWAQL$AAAAAa-NH₂ | 514 | | 2009.01 | | 2010.02 | 1005.51 | 670.68 |
| 616 Cbm-LTF$r8EYWAQCba$SAA-NH₂ | 515 | | 1590.85 | | 1591.86 | 796.43 | 531.29 |
| 617 Cbm-LTF$r8EYWAQL$AAAAAa-NH₂ | 516 | | 1930.04 | | 1931.05 | 966.03 | 644.35 |
| 618 Ac-LTF$r8EYWAQL$SAAAAa-NH₂ | 517 | | 1945.04 | 1005.11 | 1946.05 | 973.53 | 649.35 |
| 619 Ac-LTF$r8EYWAQL$AAAASa-NH₂ | 518 | | 1945.04 | 986.52 | 1946.05 | 973.53 | 649.35 |
| 620 Ac-LTF$r8EYWAQL$SAAASa-NH₂ | 519 | | 1961.03 | 993.27 | 1962.04 | 981.52 | 654.68 |
| 621 Ac-LTF$r8EYWAQTba$AAAAAa-NH₂ | 520 | | 1943.06 | 983.1 | 1944.07 | 972.54 | 648.69 |
| 622 Ac-LTF$r8EYWAQAdm$AAAAAa-NH₂ | 521 | | 2007.09 | 990.31 | 2008.1 | 1004.55 | 670.04 |
| 623 Ac-LTF$r8EYWAQCha$AAAAAa-NH₂ | 522 | | 1969.07 | 987.17 | 1970.08 | 985.54 | 657.36 |
| 624 Ac-LTF$r8EYWAQhCha$AAAAAa-NH₂ | 523 | | 1983.09 | 1026.11 | 1984.1 | 992.55 | 662.04 |
| 625 Ac-LTF$r8EYWAQF$AAAAAa-NH₂ | 524 | | 1963.02 | 957.01 | 1964.03 | 982.52 | 655.35 |
| 626 Ac-LTF$r8EYWAQhF$AAAAAa-NH₂ | 525 | | 1977.04 | 1087.81 | 1978.05 | 989.53 | 660.02 |
| 627 Ac-LTF$r8EYWAQL$AANleAAa-NH₂ | 526 | | 1971.09 | 933.45 | 1972.1 | 986.55 | 658.04 |
| 628 Ac-LTF$r8EYWAQAdm$AANleAAa-NH₂ | 527 | | 2049.13 | 1017.97 | 2050.14 | 1025.57 | 684.05 |

TABLE 1-continued

| SP Sequence | SEQ ID NO: | Isomer | Exact Mass | Found Mass | Calc (M+1)/1 | Calc (M+2)/2 | Calc (m+3)/3 |
|---|---|---|---|---|---|---|---|
| 629 4-FBz-BaLTF$r8EYWAQL$AAAAAa-NH₂ | 528 | | 2080.08 | | 2081.09 | 1041.05 | 694.37 |
| 630 4-FBz-BaLTF$r8EYWAQCba$SAA-NH₂ | 529 | | 1894.97 | | 1895.98 | 948.49 | 632.66 |
| 631 Ac-LTF$r5EYWAQL$s8AAAAAa-NH₂ | 530 | | 1929.04 | 1072.68 | 1930.05 | 965.53 | 644.02 |
| 632 Ac-LTF$r5EYWAQCba$s8SAA-NH₂ | 531 | | 1743.92 | 1107.79 | 1744.93 | 872.97 | 582.31 |
| 633 Ac-LTF$r8EYWAQL$AAhhLAAa-NH₂ | 532 | | 1999.12 | | 2000.13 | 1000.57 | 667.38 |
| 634 Ac-LTF$r8EYWAQL$AAAAAAa-NH₂ | 533 | | 2071.11 | | 2072.12 | 1036.56 | 691.38 |
| 635 Ac-LTF$r8EYWAQL$AAAAAAAa-NH₂ | 534 | | 2142.15 | 778.1 | 2143.16 | 1072.08 | 715.06 |
| 636 Ac-LTF$r8EYWAQL$AAAAAAAAa-NH₂ | 535 | | 2213.19 | 870.53 | 2214.2 | 1107.6 | 738.74 |
| 637 Ac-LTA$r8EYAAQCba$SAA-NH₂ | 536 | | 1552.85 | | 1553.86 | 777.43 | 518.62 |
| 638 Ac-LTA$r8EYAAQL$AAAAAa-NH₂ | 537 | | 1737.97 | 779.45 | 1738.98 | 869.99 | 580.33 |
| 639 Ac-LTF$r8EPmpWAQL$AAAAAa-NH₂ | 538 | | 2007.03 | 779.54 | 2008.04 | 1004.52 | 670.02 |
| 640 Ac-LTF$r8EPmpWAQCba$SAA-NH₂ | 539 | | 1821.91 | 838.04 | 1822.92 | 911.96 | 608.31 |
| 641 Ac-ATF$r8HYWAQL$S-NH₂ | 540 | | 1555.82 | 867.83 | 1556.83 | 778.92 | 519.61 |
| 642 Ac-LTF$r8HAWAQL$S-NH₂ | 541 | | 1505.84 | 877.91 | 1506.85 | 753.93 | 502.95 |
| 643 Ac-LTF$r8HYWAQA$S-NH₂ | 542 | | 1555.82 | 852.52 | 1556.83 | 778.92 | 519.61 |
| 644 Ac-LTF$r8EYWAQCba$SA-NH₂ | 543 | | 1672.89 | 887.18 | 1673.9 | 837.45 | 558.64 |
| 645 Ac-LTF$r8EYWAQL$SAA-NH₂ | 544 | | 1731.92 | 873.32 | 1732.93 | 866.97 | 578.31 |
| 646 Ac-LTF$r8HYWAQCba$SAA-NH₂ | 545 | | 1751.94 | 873.05 | 1752.95 | 876.98 | 584.99 |
| 647 Ac-LTF$r8SYWAQCba$SAA-NH₂ | 546 | | 1701.91 | 844.88 | 1702.92 | 851.96 | 568.31 |
| 648 Ac-LTF$r8RYWAQCba$SAA-NH₂ | 547 | | 1770.98 | 865.58 | 1771.99 | 886.5 | 591.33 |
| 649 Ac-LTF$r8KYWAQCba$SAA-NH₂ | 548 | | 1742.98 | 936.57 | 1743.99 | 872.5 | 582 |
| 650 Ac-LTF$r8QYWAQCba$SAA-NH₂ | 549 | | 1742.94 | 930.93 | 1743.95 | 872.48 | 581.99 |
| 651 Ac-LTF$r8EYWAACba$SAA-NH₂ | 550 | | 1686.9 | 1032.45 | 1687.91 | 844.46 | 563.31 |
| 652 Ac-LTF$r8EYWAQCba$AAA-NH₂ | 551 | | 1727.93 | 895.46 | 1728.94 | 864.97 | 576.98 |
| 653 Ac-LTF$r8EYWAQL$AAAAA-OH | 552 | | 1858.99 | 824.54 | 1860 | 930.5 | 620.67 |
| 654 Ac-LTF$r8EYWAQL$AAAA-OH | 553 | | 1787.95 | 894.48 | 1788.96 | 894.98 | 596.99 |
| 655 Ac-LTF$r8EYWAQL$AA-OH | 554 | | 1645.88 | 856 | 1646.89 | 823.95 | 549.63 |
| 656 Ac-LTF$r8AF4b0H2WAQL$AAAAAa-NH₂ | 555 | | | | | | |
| 657 Ac-LTF$r8AF4b0H2WAAL$AAAAAa-NH₂ | 556 | | | | | | |
| 658 Ac-LTF$r8EF4b0H2WAQCba$SAA-NH₂ | 557 | | | | | | |
| 659 Ac-LTF$r8ApYWAQL$AAAAAa-NH₂ | 558 | | | | | | |
| 660 Ac-LTF$r8ApYWAAL$AAAAAa-NH₂ | 559 | | | | | | |
| 661 Ac-LTF$r8EpYWAQCba$SAA-NH₂ | 560 | | | | | | |
| 662 Ac-LTF$rda6AYWAQL$daSAAAAAa-NH₂ | 561 | | 1974.06 | 934.44 | | | |
| 663 Ac-LTF$rda6EYWAQCba$daSSAA-NH₂ | 562 | | 1846.95 | 870.52 | | 869.94 | |
| 664 Ac-LTF$rda6EYWAQL$da5AAAAAa-NH₂ | 563 | | | | | | |
| 665 Ac-LTF$ra9EYWAQL$a6AAAAAa-NH₂ | 564 | | | 936.57 | 935.51 | | |
| 666 Ac-LTF$ra9EYWAQL$a6AAAAAa-NH₂ | 565 | | | | | | |

TABLE 1-continued

| SP Sequence | SEQ ID NO: | Isomer | Exact Mass | Found Mass | Calc (M+1)/1 | Calc (M+2)/2 | Calc (m+3)/3 |
|---|---|---|---|---|---|---|---|
| 667 Ac-LTF$ra9EYWAQCba$a6SAA-NH$_2$ | 566 | | | | | | |
| 668 Ac-LTA$ra9EYWAQCba$a6SAA-NH$_2$ | 567 | | | | | | |
| 669 5-FAM-BaLTF$ra9EYWAQCba$a6SAA-NH$_2$ | 568 | | | | | | |
| 670 5-FAM-BaLTF$r8EYWAQL$AAAAa-NH$_2$ | 569 | | 2316.11 | | | | |
| 671 5-FAM-BaLTF$/r8EYWAQLVAAAAa-NH$_2$ | 570 | | 2344.15 | | | | |
| 672 5-FAM-BaLTA$r8EYWAQL$AAAAa-NH$_2$ | 571 | | 2240.08 | | | | |
| 673 5-FAM-BaLTF$r8AYWAQL$AAAAa-NH$_2$ | 572 | | 2258.11 | | | | |
| 674 5-FAM-BaATF$r8EYWAQL$AAAAa-NH$_2$ | 573 | | 2274.07 | | | | |
| 675 5-FAM-BaLAF$r8EYWAQL$AAAAa-NH$_2$ | 574 | | 2286.1 | | | | |
| 676 5-FAM-BaLTF$r8EAWAQL$AAAAa-NH$_2$ | 575 | | 2224.09 | | | | |
| 677 5-FAM-BaLTF$r8EYAAQL$AAAAa-NH$_2$ | 576 | | 2201.07 | | | | |
| 678 5-FAM-BaLTA$r8EYAAQL$AAAAa-NH$_2$ | 577 | | 2125.04 | | | | |
| 679 5-FAM-BaLTF$r8EYWAAL$AAAAa-NH$_2$ | 578 | | 2259.09 | | | | |
| 680 5-FAM-BaLTF$r8EYWAQA$AAAAa-NH$_2$ | 579 | | 2274.07 | | | | |
| 681 5-FAM-BaLTF$/r8EYWAQCba$/SAA-NH$_2$ | 580 | | 2159.03 | | | | |
| 682 5-FAM-BaLTA$r8EYWAQCba$SAA-NH$_2$ | 581 | | 2054.97 | | | | |
| 683 5-FAM-BaLTF$r8EYAAQCba$SAA-NH$_2$ | 582 | | 2015.96 | | | | |
| 684 5-FAM-BaLTA$r8EYAAQCba$SAA-NH$_2$ | 583 | | 1939.92 | | | | |
| 685 5-FAM-BaQSQQTF$r8NLWRLL$QN-NH$_2$ | 584 | | 2495.23 | | | | |
| 686 5-TAMRA-BaLTF$r8EYWAQCba$SAA-NH$_2$ | 585 | | 2186.1 | | | | |
| 687 5-TAMRA-BaLTA$r8EYWAQCba$SAA-NH$_2$ | 586 | | 2110.07 | | | | |
| 688 5-TAMRA-BaLTF$r8EYAAQCba$SAA-NH$_2$ | 587 | | 2071.06 | | | | |
| 689 5-TAMRA-BaLTA$r8EYAAQCba$SAA-NH$_2$ | 588 | | 1995.03 | | | | |
| 690 5-TAMRA-BaLTF$/r8EYWAQCba$/SAA-NH$_2$ | 589 | | 2214.13 | | | | |
| 691 5-TAMRA-BaLTF$r8EYWAQL$AAAAa-NH$_2$ | 590 | | 2371.22 | | | | |
| 692 5-TAMRA-BaLTA$r8EYWAQL$AAAAa-NH$_2$ | 591 | | 2295.19 | | | | |
| 693 5-TAMRA-BaLTF$/r8EYWAQLVAAAAa-NH$_2$ | 592 | | 2399.25 | | | | |
| 694 Ac-LTF$r8EYWCou7QCba$SAA-OH | 593 | | 1947.93 | | | | |
| 695 Ac-LTF$r8EYWCou7QCba$S-OH | 594 | | 1805.86 | | | | |
| 696 Ac-LTA$r8EYWCou7QCba$SAA-NH$_2$ | 595 | | 1870.91 | | | | |
| 697 Ac-LTF$r8EYACou7QCba$SAA-NH$_2$ | 596 | | 1831.9 | | | | |
| 698 Ac-LTA$r8EYACou7QCba$SAA-NH2 | 597 | | 1755.87 | | | | |
| 699 Ac-LTF$/r8EYWCou7QCba$/SAA-NH$_2$ | 598 | | 1974.98 | | | | |
| 700 Ac-LTF$r8EYWCou7QL$AAAAa-NH$_2$ | 599 | | 2132.06 | | | | |
| 701 Ac-LTF$/r8EYWCou7QLS/AAAAa-NH$_2$ | 600 | | 2160.09 | | | | |
| 702 Ac-LTF$r8EYWCou7QL$AAAAA-OH | 601 | | 2062.01 | | | | |
| 703 Ac-LTF$r8EYWCou7QL$AAAA-OH | 602 | | 1990.97 | | | | |
| 704 Ac-LTF$r8EYWCou7QL$AAA-OH | 603 | | 1919.94 | | | | |

TABLE 1-continued

| SP Sequence | SEQ ID NO: | Isomer | Exact Mass | Found Mass | Calc (M+1)/1 | Calc (M+2)/2 | Calc (m+3)/3 |
|---|---|---|---|---|---|---|---|
| 705 Ac-LTF$r8EYWCou7QL$AA-OH | 604 | | 1848.9 | | | | |
| 706 Ac-LTF$r8EYWCou7QL$A-OH | 605 | | 1777.86 | | | | |
| 707 Ac-LTF$r8EYWAQL$AAAASa-NH$_2$ | 606 | iso2 | | 974.4 | | 973.53 | |
| 708 Ac-LTF$r8AYWAAL$AAAAAa-NH$_2$ | 607 | iso2 | 1814.01 | 908.82 | 1815.02 | 908.01 | 605.68 |
| 709 Biotin-BaLTF$r8EYWAQL$AAAAAa-NH$_2$ | 608 | | 2184.14 | 1093.08 | 2185.15 | 1093.64 | 729.05 |
| 710 Ac-LTF$r8HAWAQL$S-NH$_2$ | 609 | iso2 | 1505.84 | 754.43 | 1506.85 | 753.93 | 502.95 |
| 711 Ac-LTF$r8EYWAQCba$SA-NH$_2$ | 610 | iso2 | 1672.89 | 838.05 | 1673.9 | 837.45 | 558.64 |
| 712 Ac-LTF$r8HYWAQCba$SAA-NH$_2$ | 611 | iso2 | 1751.94 | 877.55 | 1752.95 | 876.98 | 584.99 |
| 713 Ac-LTF$r8SYWAQCba$SAA-NH$_2$ | 612 | iso2 | 1701.91 | 852.48 | 1702.92 | 851.96 | 568.31 |
| 714 Ac-LTF$r8RYWAQCba$SAA-NH$_2$ | 613 | iso2 | 1770.98 | 887.45 | 1771.99 | 886.5 | 591.33 |
| 715 Ac-LTF$r8KYWAQCba$SAA-NH$_2$ | 614 | iso2 | 1742.98 | 872.92 | 1743.99 | 872.5 | 582 |
| 716 Ac-LTF$r8EYWAQCba$AAA-NH$_2$ | 615 | iso2 | 1727.93 | 865.71 | 1728.94 | 864.97 | 576.98 |
| 717 Ac-LTF$r8EYWAQL$AAAAAaBaC-NH$_2$ | 616 | | 2103.09 | 1053.12 | 2104.1 | 1052.55 | 702.04 |
| 718 Ac-LTF$r8EYWAQL$AAAAAadPeg4C-NH$_2$ | 617 | | 2279.19 | 1141.46 | 2280.2 | 1140.6 | 760.74 |
| 719 Ac-LTA$r8AYWAAL$AAAAAa-NH$_2$ | 618 | | 1737.98 | 870.43 | 1738.99 | 870 | 580.33 |
| 720 Ac-LTF$r8AYAAAL$AAAAAa-NH$_2$ | 619 | | 1698.97 | 851 | 1699.98 | 850.49 | 567.33 |
| 721 5-FAM-BaLTF$r8AYWAAL$AAAAAa-NH$_2$ | 620 | | 2201.09 | 1101.87 | 2202.1 | 1101.55 | 734.7 |
| 722 722Ac-LTA$r8AYWAQL$AAAAAa-NH$_2$ | 621 | | 1795 | 898.92 | 1796.01 | 898.51 | 599.34 |
| 723 723Ac-LTF$r8AYAAQL$AAAAAa-NH$_2$ | 622 | | 1755.99 | 879.49 | 1757 | 879 | 586.34 |
| 724 Ac-LTF$rda6AYWAAL$da5AAAAAa-NH$_2$ | 623 | | 1807.97 | | 1808.98 | 904.99 | 603.66 |
| 725 FITC-BaLTF$r8EYWAQL$AAAAAa-NH$_2$ | 624 | | 2347.1 | 1174.49 | 2348.11 | 1174.56 | 783.37 |
| 726 FITC-BaLTF$r8EYWAQCba$SAA-NH$_2$ | 625 | | 2161.99 | 1082.35 | 2163 | 1082 | 721.67 |
| 733 Ac-LTF$r8EYWAQL$EAAAa-NH$_2$ | 626 | | 1987.05 | 995.03 | 1988.06 | 994.53 | 663.36 |
| 734 Ac-LTF$r8AYWAQL$EAAAAa-NH$_2$ | 627 | | 1929.04 | 966.35 | 1930.05 | 965.53 | 644.02 |
| 735 Ac-LTF$r8EYWAQL$AAAAAaBaKbio-NH$_2$ | 628 | | 2354.25 | 1178.47 | 2355.26 | 1178.13 | 785.76 |
| 736 Ac-LTF$r8AYWAAL$AAAAAa-NH$_2$ | 629 | | 1814.01 | 908.45 | 1815.02 | 908.01 | 605.68 |
| 737 Ac-LTF$r8AYAAAL$AAAAAa-NH$_2$ | 630 | iso2 | 1698.97 | 850.91 | 1699.98 | 850.49 | 567.33 |
| 738 Ac-LTF$r8AYAAQL$AAAAAa-NH$_2$ | 631 | iso2 | 1755.99 | 879.4 | 1757 | 879 | 586.34 |
| 739 Ac-LTF$r8EYWAQL$EAAAAa-NH$_2$ | 632 | iso2 | 1987.05 | 995.21 | 1988.06 | 994.53 | 663.36 |
| 740 Ac-LTF$r8AYWAQL$EAAAAa-NH$_2$ | 633 | iso2 | 1929.04 | 966.08 | 1930.05 | 965.53 | 644.02 |
| 741 Ac-LTF$r8EYWAQCba$SAAAa-NH$_2$ | 634 | | 1957.04 | 980.04 | 1958.05 | 979.53 | 653.35 |
| 742 Ac-LTF$r8EYWAQLStAAA$rSAA-NH$_2$ | 635 | | 2023.12 | 1012.83 | 2024.13 | 1012.57 | 675.38 |
| 743 Ac-LTF$r8EYWAQL$A$AAA$A-NH$_2$ | 636 | | 2108.17 | 1055.44 | 2109.18 | 1055.09 | 703.73 |
| 744 Ac-LTF$r8EYWAQL$AA$AAA$A-NH$_2$ | 637 | | 2179.21 | 1090.77 | 2180.22 | 1090.61 | 727.41 |
| 745 Ac-LTF$r8EYWAQL$AAA$AAA$A-NH$_2$ | 638 | | 2250.25 | 1126.69 | 2251.26 | 1126.13 | 751.09 |
| 746 Ac-AAALTF$r8EYWAQL$AAA-OH | 639 | | 1930.02 | | 1931.03 | 966.02 | 644.35 |
| 747 Ac-AAALTF$r8EYWAQL$AAA-NH$_2$ | 640 | | 1929.04 | 965.85 | 1930.05 | 965.53 | 644.02 |
| 748 Ac-AAAALTF$r8EYWAQL$AAA-NH$_2$ | 641 | | 2000.08 | 1001.4 | 2001.09 | 1001.05 | 667.7 |

TABLE 1-continued

| SP Sequence | SEQ ID NO: | Isomer | Exact Mass | Found Mass | Calc (M+1)/1 | Calc (M+2)/2 | Calc (m+3)/3 |
|---|---|---|---|---|---|---|---|
| 749Ac-AAAAALTF$r8EYWAQL$AAA-NH$_2$ | 642 | | 2071.11 | 1037.13 | 2072.12 | 1036.56 | 691.38 |
| 750Ac-AAAAAALTF$r8EYWAQL$AAA-NH$_2$ | 643 | | 2142.15 | | 2143.16 | 1072.08 | 715.06 |
| 751Ac-LTF$rda6EYWAQCba$da6SAA-NH$_2$ | 644 | iso2 | 1751.89 | 877.36 | 1752.9 | 876.95 | 584.97 |
| 752Ac-t$r5a$r5f4CF3ekl1r-NH$_2$ | 645 | | | 844.25 | | | |
| 753Ac-tawy$r5nf4CF3e$r5llr-NH$_2$ | 646 | | | 837.03 | | | |
| 754Ac-tawya$r5f4CF3ek$r5lr-NH$_2$ | 647 | | | 822.97 | | | |
| 755Ac-tawyanf4CF3e$r5llr$r5a-NH$_2$ | 648 | | | 908.35 | | | |
| 756Ac-t$s8anf4CF3e$r5ll r-NH2 | 649 | | | 858.03 | | | |
| 757Ac-tawy$s8nf4CF3ekll$r5a-NH$_2$ | 650 | | | 879.86 | | | |
| 758Ac-tawya$s8f4CF3ekllr$r5a-NH$_2$ | 651 | | | 936.38 | | | |
| 759Ac-tawy$s8naekll$r5a-NH$_2$ | 652 | | | 844.25 | | | |
| 7605-FAM-Batawy$s8nf4CF3ekll$r5a-NH$_2$ | 653 | | | | | | |
| 7615-FAM-Batawy$s8naekll$r5a-NH$_2$ | 654 | | | | | | |
| 762Ac-tawy$s8nf4CF3eall$r5a-NH$_2$ | 655 | | | | | | |
| 763Ac-tawy$s8nf4CF3ekll$r5aaaaa-NH$_2$ | 656 | | | | | | |
| 764Ac-tawy$s8nf4CF3eall$r5aaaaa-NH$_2$ | 657 | | | | | | |

TABLE 1a shows a selection of peptidomimetic macrocycles.

TABLE 1a

| SP Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|
| 244Ac-LTF$r8EF4coohWAQCba$SANleA-NH$_2$ | 658 | | 1885 | 943.59 | 1886.01 | 943.51 | 629.34 |
| 331Ac-LTF$r8EYWAQL$AAAAAa-NH$_2$ | 659 | iso2 | 1929.04 | 966.08 | 1930.05 | 965.53 | 644.02 |
| 555Ac-LTF$r8EY6clWAQL$AAAAAa-NH$_2$ | 660 | | 1963 | 983.28 | 1964.01 | 982.51 | 655.34 |
| 557Ac-AAALTF$r8EYWAQL$AAAAAa-NH$_2$ | 661 | | 2142.15 | 1072.83 | 2143.16 | 1072.08 | 715.06 |
| 558Ac-LTF34F2$r8EYWAQL$AAAAAa-NH$_2$ | 662 | | 1965.02 | 984.3 | 1966.03 | 983.52 | 656.01 |
| 562Ac-LTF$r8EYWAQL$AAibAAAa-NH$_2$ | 663 | | 1943.06 | 973.11 | 1944.07 | 972.54 | 648.69 |
| 564Ac-LTF$r8EYWAQL$AAAAibAa-NH$_2$ | 664 | | 1943.06 | 973.48 | 1944.07 | 972.54 | 648.69 |
| 566Ac-LTF$r8EYWAQL$AAAAAiba-NH$_2$ | 665 | iso2 | 1943.06 | 973.38 | 1944.07 | 972.54 | 648.69 |
| 567Ac-LTF$r8EYWAQL$AAAAAAib-NH$_2$ | 666 | | 1943.06 | 973.01 | 1944.07 | 972.54 | 648.69 |
| 572Ac-LTF$r8EYWAQL$AAAAaa-NH$_2$ | 667 | | 1929.04 | 966.35 | 1930.05 | 965.53 | 644.02 |
| 573Ac-LTF$r8EYWAQL$AAAAAA-NH$_2$ | 668 | | 1929.04 | 966.35 | 1930.05 | 965.53 | 644.02 |
| 578Ac-LTF$r8EYWAQL$AAAAASar-NH$_2$ | 669 | | 1929.04 | 966.08 | 1930.05 | 965.53 | 644.02 |
| 551Ac-LTF$r8EYWAQL$AAAAAa-OH | 670 | iso2 | 1930.02 | 965.89 | 1931.03 | 966.02 | 644.35 |
| 662Ac-LTF$rda6AYWAQL$da5AAAAAa-NH$_2$ | 671 | | 1974.06 | 934.44 | | 933.49 | |
| 3675-FAM-BaLTF$r8EYWAQCba$SAA-NH$_2$ | 672 | | 2131 | 1067.09 | 2132.01 | 1066.51 | 711.34 |

TABLE 1a-continued

| SP Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|
| 349 Ac-LTF$r8EF4coohWAQCba$AAAAAa-NH₂ | 673 | iso2 | 1969.04 | 986.06 | 1970.05 | 985.53 | 657.35 |
| 347 Ac-LTF$r8EYWAQCba$AAAAAa-NH₂ | 674 | iso2 | 1941.04 | 972.55 | 1942.05 | 971.53 | 648.02 |

TABLE 1b shows a further selection of peptidomimetic macrocycles.

TABLE 1b

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| 581 | Ac-TF$r8EYWAQL$AAAAAa-NH₂ | 675 | | 1815.96 | 929.85 | 1816.97 | 908.99 | 606.33 |
| 582 | Ac-F$r8EYWAQL$AAAAAa-NH₂ | 676 | | 1714.91 | 930.92 | 1715.92 | 858.46 | 572.64 |
| 583 | Ac-LVF$r8EYWAQL$AAAAAa-NH₂ | 677 | | 1927.06 | 895.12 | 1928.07 | 964.54 | 643.36 |
| 584 | Ac-AAF$r8EYWAQL$AAAAAa-NH₂ | 678 | | 1856.98 | 859.51 | 1857.99 | 929.5 | 620 |
| 585 | Ac-LTF$r8EYWAQL$AAAAAa-NH₂ | 679 | | 1858 | 824.08 | 1859.01 | 930.01 | 620.34 |
| 586 | Ac-LTF$r8EYWAQL$AAAAa-NH₂ | 680 | | 1786.97 | 788.56 | 1787.98 | 894.49 | 596.66 |
| 587 | Ac-LTF$r8EYWAQL$AAAa-NH₂ | 681 | | 1715.93 | 1138.57 | 1716.94 | 858.97 | 572.98 |
| 588 | Ac-LTF$r8EYWAQL$AAa-NH₂ | 682 | | 1644.89 | 1144.98 | 1645.9 | 823.45 | 549.3 |
| 589 | Ac-LTF$r8EYWAQL$a-NH₂ | 683 | | 1573.85 | 1113.71 | 1574.86 | 787.93 | 525.62 |

In the sequences shown above and elsewhere, the following abbreviations are used: "Nle" represents norleucine, "Aib" represents 2-aminoisobutyric acid, "Ac" represents acetyl, and "Pr" represents propionyl. Amino acids represented as "$" are alpha-Me S5-pentenyl-alanine olefin amino acids connected by an all-carbon crosslinker comprising one double bond. Amino acids represented as "$r5" are alpha-Me R5-pentenyl-alanine olefin amino acids connected by an all-carbon comprising one double bond. Amino acids represented as "$s8" are alpha-Me S8-octenyl-alanine olefin amino acids connected by an all-carbon crosslinker comprising one double bond. Amino acids represented as "$r8" are alpha-Me R8-octenyl-alanine olefin amino acids connected by an all-carbon crosslinker comprising one double bond. "Ahx" represents an aminocyclohexyl linker.

The crosslinkers are linear all-carbon crosslinker comprising eight or eleven carbon atoms between the alpha carbons of each amino acid. Amino acids represented as "$/" are alpha-Me S5-pentenyl-alanine olefin amino acids that are not connected by any crosslinker. Amino acids represented as "$/r5" are alpha-Me R5-pentenyl-alanine olefin amino acids that are not connected by any crosslinker. Amino acids represented as "$/s8" are alpha-Me S8-octenyl-alanine olefin amino acids that are not connected by any crosslinker. Amino acids represented as "$/r8" are alpha-Me R8-octenyl-alanine olefin amino acids that are not connected by any crosslinker.

Amino acids represented as "Amw" are alpha-Me tryptophan amino acids. Amino acids represented as "Aml" are alpha-Me leucine amino acids. Amino acids represented as "Amf" are alpha-Me phenylalanine amino acids. Amino acids represented as "2ff" are 2-fluoro-phenylalanine amino acids. Amino acids represented as "3ff" are 3-fluoro-phenylalanine amino acids. Amino acids represented as "St" are as indicated. Amino acids represented as "St//" are amino acids comprising two pentenyl-alanine olefin side chains that are not crosslinked. Amino acids represented as "% St" are amino acids comprising two pentenyl-alanine olefin side chains, each of which is crosslinked to another amino acid as indicated via fully saturated hydrocarbon crosslinks. Amino acids represented as "Ba" are beta-alanine. The lower-case character "e" or "z" within the designation of a crosslinked amino acid (e.g. "$er8" or "$zr8") represents the configuration of the double bond (E or Z, respectively). In other contexts, lower-case letters such as "a" or "f" represent D amino acids (e.g. D-alanine, or D-phenylalanine, respectively).

Amino acids designated as "NmW" represent N-methyltryptophan. Amino acids designated as "NmY" represent N-methyltyrosine. Amino acids designated as "NmA" represent N-methylalanine. "Kbio" represents a biotin group attached to the side chain amino group of a lysine residue. Amino acids designated as "Sar" represent sarcosine. Amino acids designated as "Cha" represent cyclohexyl alanine. Amino acids designated as "Cpg" represent cyclopentyl glycine. Amino acids designated as "Chg" represent cyclohexyl glycine. Amino acids designated as "Cba" represent cyclobutyl alanine. Amino acids designated as "F4I" represent 4-iodo phenylalanine. "7L" represents N15 isotopic leucine. Amino acids designated as "F3Cl" represent 3-chloro phenylalanine. Amino acids designated as "F4cooh" represent 4-carboxy phenylalanine. Amino acids designated as "F34F2" represent 3,4-difluoro phenylalanine. Amino acids designated as "6clW" represent 6-chloro tryptophan. Amino acids designated as "$rda6" represent alpha-Me R6-hexynyl-alanine alkynyl amino acids, crosslinked via a dialkyne bond to a second alkynyl amino acid.

Amino acids designated as "$da5" represent alpha-Me S5-pentynyl-alanine alkynyl amino acids, wherein the alkyne forms one half of a dialkyne bond with a second alkynyl amino acid. Amino acids designated as "$ra9" represent alpha-Me R9-nonynyl-alanine alkynyl amino acids, crosslinked via an alkyne metathesis reaction with a second alkynyl amino acid. Amino acids designated as "$a6" represent alpha-Me S6-hexynyl-alanine alkynyl amino acids, crosslinked via an alkyne metathesis reaction with a second alkynyl amino acid. The designation "iso1" or "iso2" indicates that the peptidomimetic macrocycle is a single isomer.

Amino acids designated as "Cit" represent citrulline. Amino acids designated as "Cou4", "Cou6", "Cou7" and "Cou8", respectively, represent the following structures:

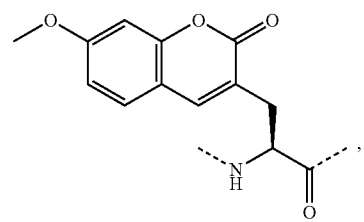

Cou

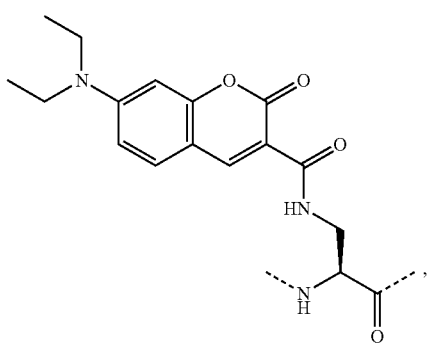

Cou2

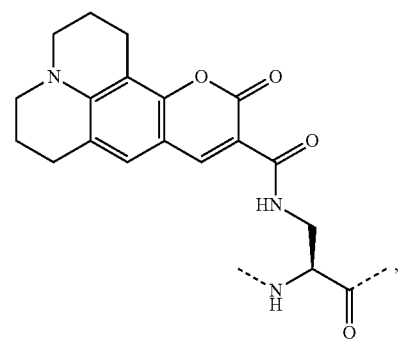

Cou3

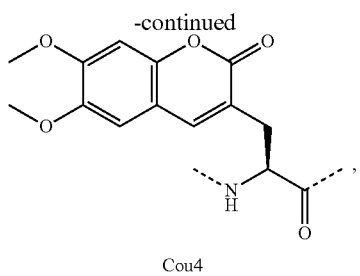

Cou4

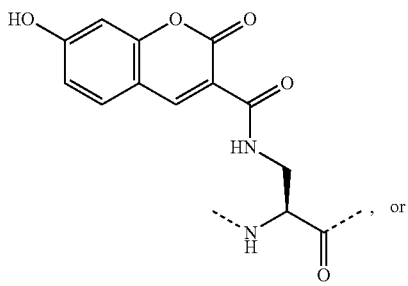

Cou6

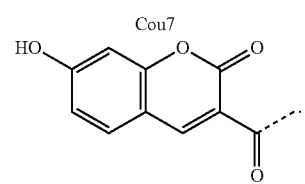

Cou7, or

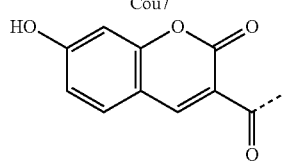

Cou8

In some embodiments, a peptidomimetic macrocycle is obtained in more than one isomer, for example due to the configuration of a double bond within the structure of the crosslinker (E vs Z). Such isomers can or cannot be separable by conventional chromatographic methods. In some embodiments, one isomer has improved biological properties relative to the other isomer. In one embodiment, an E crosslinker olefin isomer of a peptidomimetic macrocycle has better solubility, better target affinity, better in vivo or in vitro efficacy, higher helicity, or improved cell permeability relative to its Z counterpart. In another embodiment, a Z crosslinker olefin isomer of a peptidomimetic macrocycle has better solubility, better target affinity, better in vivo or in vitro efficacy, higher helicity, or improved cell permeability relative to its E counterpart.

TABLE 1c shows exemplary peptidomimetic macrocycles.

TABLE 1c
| SP# | SEQ ID NO: | Structure |
|---|---|---|
| 154 | 154 | 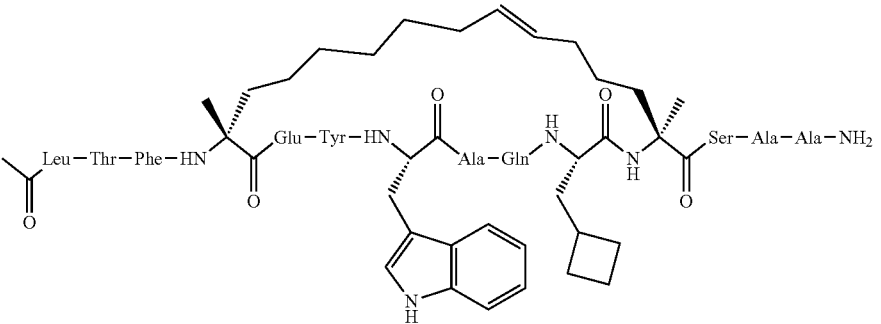
Chemical Formula: $C_{87}H_{125}N_{17}O_{21}$
Exact Mass: 1743.92
Molecular Weight: 1745.02
Ac—LTF$er8EYWAQCba$eSAA—NH2 |
| 115 | 115 | 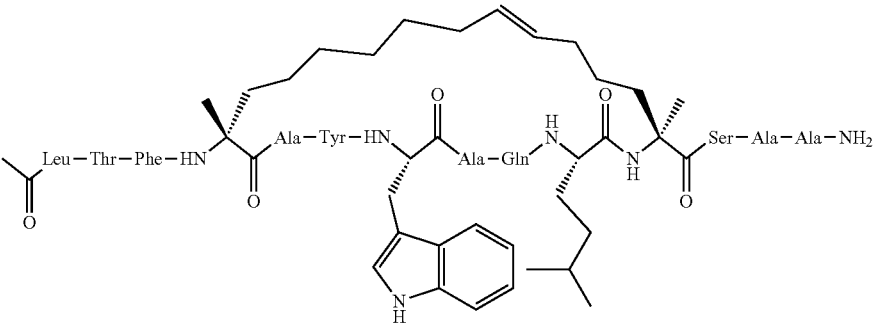
Chemical Formula: $C_{85}H_{125}N_{17}O_{19}$
Exact Mass: 1687.93
Molecular Weight: 1689.00
Ac—LTF$er8AYWAQhL$eSAA—NH2 |
| 114 | 114 | 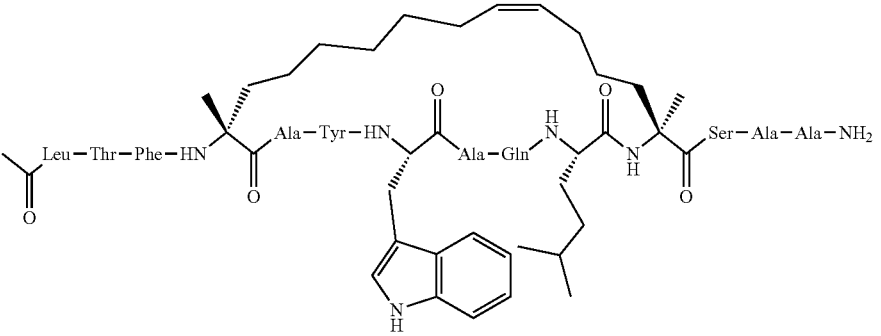
Chemical Formula: $C_{85}H_{125}N_{17}O_{19}$
Exact Mass: 1687.93
Molecular Weight: 1689.00
Ac—LTF$zr8AYWAQhL$zSAA—NH2 |

TABLE 1c-continued

| SP# | SEQ ID NO: | Structure |
|---|---|---|
| 99 | 99 | 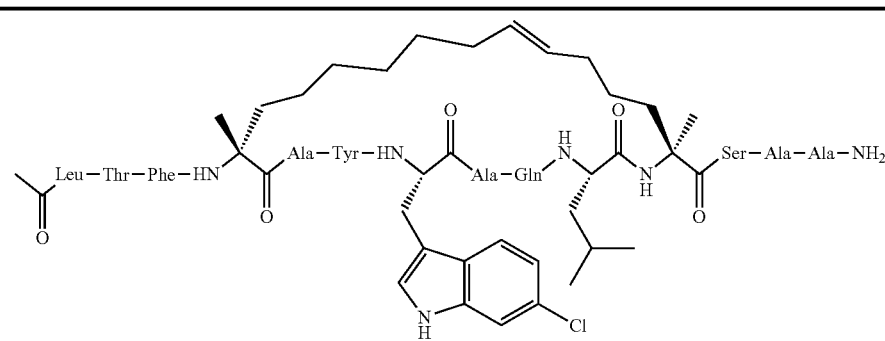
Chemical Formula: C₈₄H₁₂₂ClN₁₇O₁₉
Exact Mass: 1707.88
Molecular Weight: 1709.42
Ac—LTF$er8AY6clWAQL$eSAA—NH2 |
| 388 | 388 | 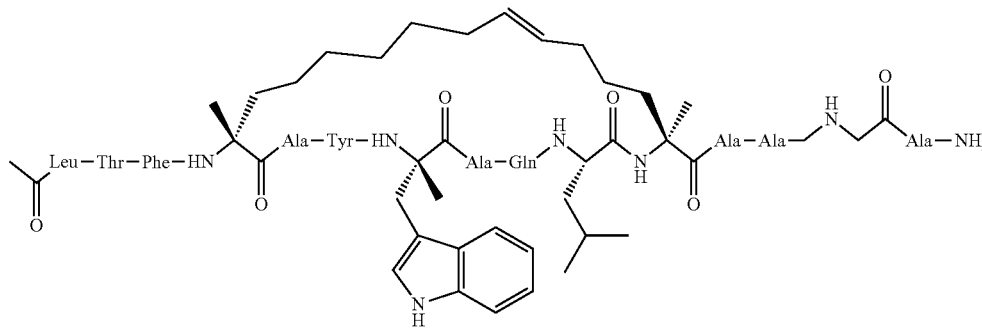
Chemical Formula: C₉₁H₁₃₆N₁₈O₁₉
Exact Mass: 1785.02
Molecular Weight: 1786.16
Ac—LTF$er8AYAmwAQL$eAANleA—NH2 |
| 331 | 331 | 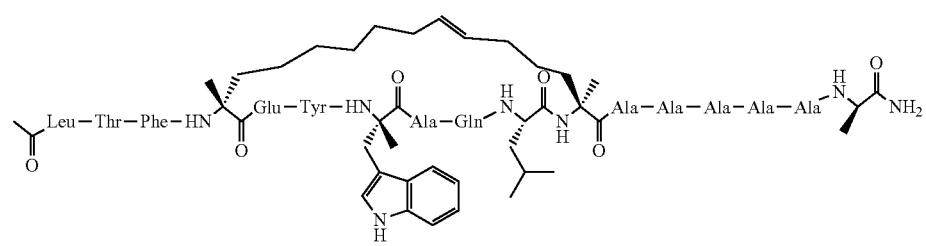
Chemical Formula: C₉₅H₁₄₀N₂₀O₂₃
Exact Mass: 1929.04
Molecular Weight: 1930.25
Ac—L T F$er8EYWAQL$eAAAAAa—NH2 |
| 445 | 445 | 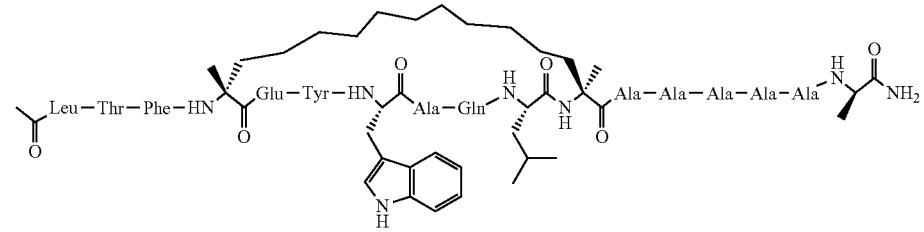
Chemical Formula: C₉₅H₁₄₂N₂₀O₂₃
Exact Mass: 1931.06
Molecular Weight: 1932.26
Ac—LTF%r8EYWAQL%AAAAAa—NH2 |

TABLE 1c-continued
| SP# | SEQ ID NO: | Structure |
|---|---|---|
| 351 | 351 | 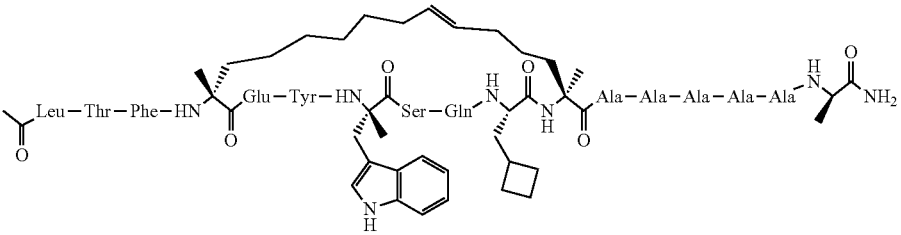
Chemical Formula: $C_{96}H_{140}N_{20}O_{24}$
Exact Mass: 1957.03
Molecular Weight: 1958.26
Ac—LTF$er8EYWSQCba$eAAAAAa—NH2 |
| 71 | 71 | 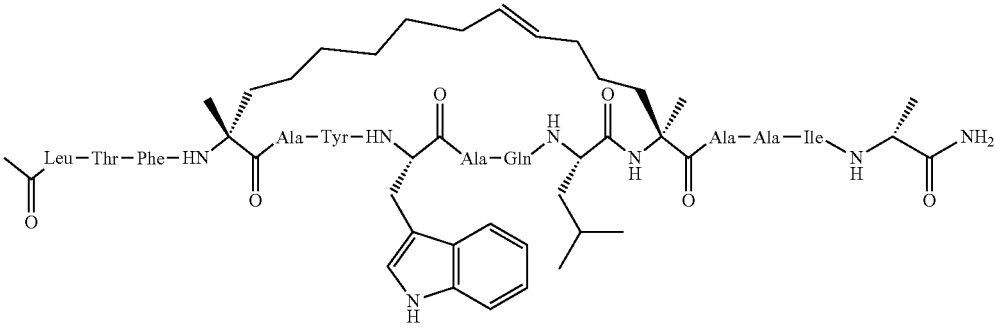
Formula: $C_{90}H_{134}N_{18}O_{19}$
Exact Mass: 1771.01
Molecular Weight: 1772.14
Ac—LTF$er8AYWAQL$eAAIa—NH2 |
| 69 | 69 | 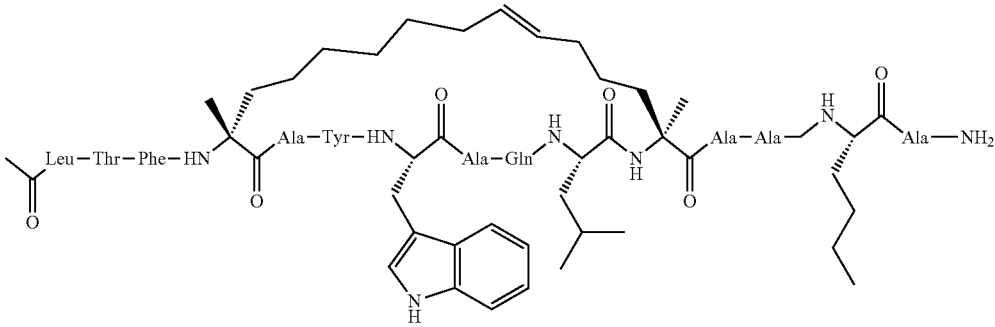
Chemical Formula: $C_{90}H_{134}N_{18}O_{19}$
Exact Mass: 1771.01
Molecular Weight: 1772.14
Ac—LTF$er8AYWAQL$eAANleA—NH2 |
| 7 | 7 | 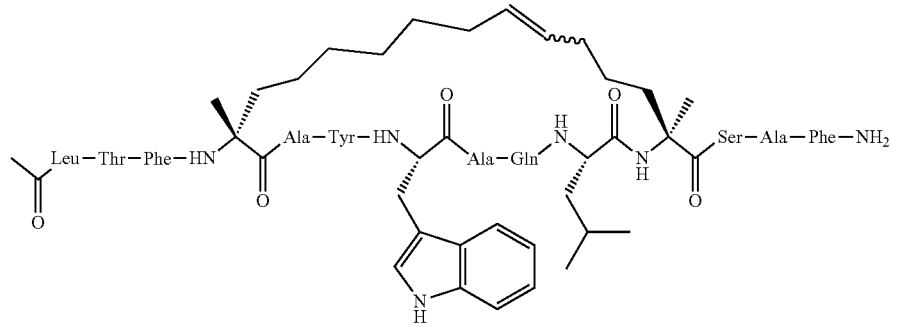 |

TABLE 1c-continued

| SP# | SEQ ID NO: | Structure |
|---|---|---|
| 160 | 160 | Chemical Formula: $C_{90}H_{127}N_{17}O_{19}$<br>Exact Mass: 1749.95<br>Molecular Weight: 1751.07<br>Ac—LTF$r8AYWAQL$SAF—NH2 |
| 315 | 315 | Chemical Formula: $C_{87}H_{125}F_2N_{17}O_{21}$<br>Exact Mass: 1781.92<br>Molecular Weight: 1783.02<br>A—LTF34F2$er8EYWAQhL$eSAA—NH2 |
| 249 | 249 | Chemical Formula: $C_{93}H_{138}N_{20}O_{21}$<br>Exact Mass: 1871.03<br>Molecular Weight: 1872.21<br>Ac—LTF$er8AYWAQL$eAAAAAa—NH2 |
| | | Chemical Formula: $C_{94}H_{136}N_{18}O_{22}$<br>Exact Mass: 1869.01<br>Molecular Weight: 1870.19<br>Ac—LTF$er8EF4coohWAQCba$eAA—I—a—NH2 |

TABLE 1c-continued

| SP# | SEQ ID NO: | Structure |
|---|---|---|
| 437 | 437 | Chemical Formula: $C_{95}H_{143}N_{21}O_{21}$<br>Exact Mass: 1914.08<br>Molecular Weight: 1915.28<br>Dmaac—LTF$er8AYWAQL$eAAAAAa—NH2 |
| 349 | 349 | Chemical Formula: $C_{97}H_{140}N_{20}O_{24}$<br>Exact Mass: 1969.03<br>Molecular Weight: 1970.27<br>Ac—LTF$er8EF4coohWAQCba$eAAAAAa—NH2 |
| 555 | 455 | Chemical Formula: $C_{95}H_{139}ClN_{20}O_{23}$<br>Exact Mass: 1963.69<br>Molecular Weight: 1964.69<br>Ac—LTF$er8EY6clWAQL$eAAAAAa—NH2 |
| 557 | 457 | Chemical Formula: $C_{104}H_{155}N_{23}O_{26}$<br>Exact Mass: 2142.15<br>Molecular Weight: 2143.48<br>Ac—AAALTF$er8EYWAQL$eAAAAAa—NH2 |

TABLE 1c-continued
| SP# | SEQ ID NO: | Structure |
|---|---|---|
| 558 | 458 | 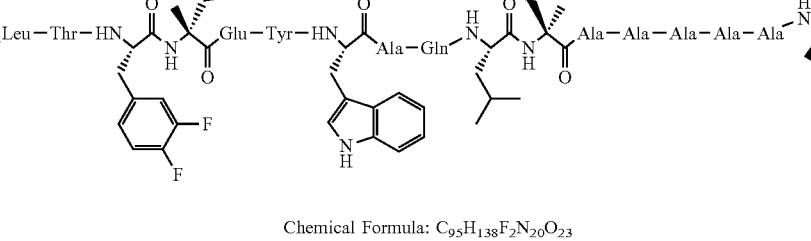
Chemical Formula: $C_{95}H_{138}F_2N_{20}O_{23}$
Exact Mass: 1965.02
Molecular Weight: 1966.23
Ac—LTF34F2$er8EYVVAQL$eAAAAAa—NH2 |
| 367 | 367 | 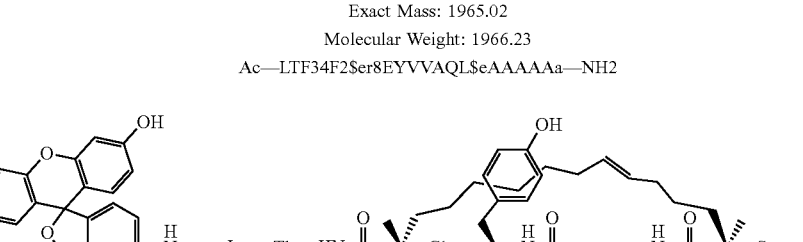
5-FAM—BaLTF$er8EYWAQCba5eSAA—NH2 |
| 562 | 462 | 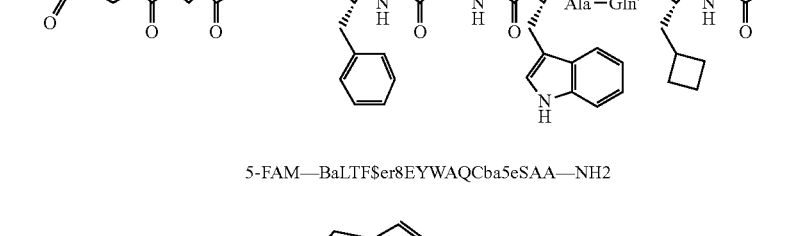
Chemical Formula: $C_{96}H_{142}N_{20}O_{23}$
Exact Mass: 1943.06
Molecular Weight: 1944.27
Ac—LTF$er8EYWAQL$eAAibAAAa—NH2 |
| 564 | 464 | 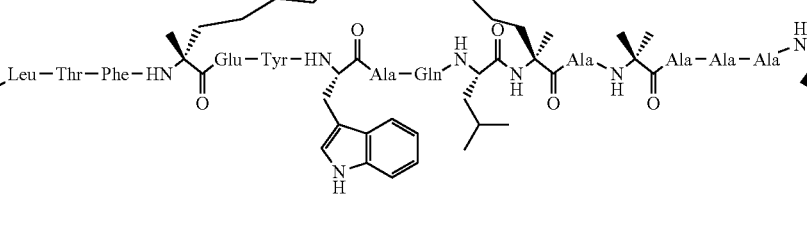
Chemical Formula: $C_{96}H_{142}N_{20}O_{23}$
Exact Mass: 1943.06
Molecular Weight: 1944.27
Ac—LTF$er8EYWAQL$eAAAAibAa—NH2 |

TABLE 1c-continued

| SP# | SEQ ID NO: | Structure |
|---|---|---|
| 566 | 466 | [structure image] |
| 567 | 467 | [structure image]<br>Chemical Formula: $C_{96}H_{142}N_{20}O_{23}$<br>Exact Mass: 1943.06<br>Molecular Weight: 1944.27<br>Ac—LTF$er8EYVVAQL$eAAAAAAib—NH2 |
| 572 | 472 | [structure image]<br>Chemical Formula: $C_{95}H_{140}N_{20}O_{23}$<br>Exact Mass: 1929.04<br>Molecular Weight: 1930.25<br>Ac—LTF$er8EYWAQL$eAAAAaa—NH2 |
| 573 | 473 | [structure image]<br>Chemical Formula: $C_{95}H_{140}N_{20}O_{23}$<br>Exact Mass: 1929.04<br>Molecular Weight: 1930.25<br>Ac—LTF$er8EYWAQL$eAAAAAA—NH2 |

TABLE 1c-continued

| SP# | SEQ ID NO: | Structure |
|---|---|---|
| 578 | 478 | Chemical Formula: $C_{95}H_{140}N_{20}O_{23}$<br>Exact Mass: 1929.04<br>Molecular Weight: 1930.25<br>Ac—LTF$er8EYWAQL5eAAAAASar—NH2 |
| 664 | 563 | Chemical Formula: $C_{95}H_{134}N_{20}O_{23}$<br>Exact Mass: 1922.99<br>Molecular Weight: 1924.20<br>Ac—LTF$rda6EYWAQL$da5AAAAAa—NH2 |
| 662 | 563 | Chemical Formula: $C_{95}H_{134}N_{20}O_{23}$<br>Exact Mass: 1922.99<br>Molecular Weight: 1924.20<br>Ac—LTF$rda6EYWAQL$da5AAAAAa—NH2 |
| | 684 | Chemical Formula: $C_{96}H_{136}N_{20}O_{23}$<br>Exact Mass: 1937.01<br>Molecular Weight: 1938.23 |

In some embodiments, peptidomimetic macrocycles include peptidomimetic macrocycles shown in TABLE 2a:

TABLE 2a

| Sequence | SEQ ID NO: |
|---|---|
| L$r5QETFSD$s8WKLLPEN | 685 |
| LSQ$r5TFSDLW$s8LLPEN | 686 |
| LSQE$r5FSDLWK$s8LPEN | 687 |
| LSQET$r5SDLWKL$s8PEN | 688 |
| LSQETF$r5DLWKLL$s8EN | 689 |
| LXQETFS$r5LWKLLP$s8N | 690 |
| LSQETFSD$r5WKLLPE$s8 | 691 |
| LSQQTF$r5DLWKLL$s8EN | 692 |
| LSQETF$r5DLWKLL$s8QN | 693 |
| LSQQTF$r5DLWKLL$s8QN | 694 |
| LSQETF$r5NLWKLL$s8QN | 695 |
| LSQQTF$r5NLWKLL$s8QN | 696 |
| LSQQTF$r5NLWRLL$s8QN | 697 |
| QSQQTF$r5NLWKLL$s8QN | 698 |
| QSQQTF$r5NLWRLL$s8QN | 699 |
| QSQQTA$r5NLWRLL$s8QN | 700 |
| L$r8QETFSD$WKLLPEN | 701 |
| LSQ$r8TFSDLW$LLPEN | 702 |
| LSQE$r8FSDLWK$LPEN | 703 |
| LSQET$r8SDLWKL$PEN | 704 |
| LSQETF$r8DLWKLL$EN | 705 |
| LXQETFS$r8LWKLLP$N | 706 |
| LSQETFSD$r8WKLLPE$ | 707 |
| LSQQTF$r8DLWKLL$EN | 708 |
| LSQETF$r8DLWKLL$QN | 709 |
| LSQQTF$r8DLWKLL$QN | 710 |

TABLE 2a-continued

| Sequence | SEQ ID NO: |
|---|---|
| LSQETF$r8NLWKLL$QN | 711 |
| LSQQTF$r8NLWKLL$QN | 712 |
| LSQQTF$r8NLWRLL$QN | 713 |
| QSQQTF$r8NLWKLL$QN | 714 |
| QSQQTF$r8NLWRLL$QN | 715 |
| QSQQTA$r8NLWRLL$QN | 716 |
| QSQQTF$r8NLWRKK$QN | 717 |
| QQTF$r8DLWRLL$EN | 718 |
| QQTF$r8DLWRLL$ | 719 |
| LSQQTF$DLW$LL | 720 |
| QQTF$DLW$LL | 721 |
| QQTA$r8DLWRLL$EN | 722 |
| QSQQTF$r5NLWRLL$s8QN (dihydroxylated olefin) | 723 |
| QSQQTA$r5NLWRLL$s8QN (dihydroxylated olefin) | 724 |
| QSQQTF$r8DLWRLL$QN | 725 |
| QTF$r8NLWRLL$ | 726 |
| QSQQTF$NLW$LLPQN | 727 |
| QS$QTF$NLWRLLPQN | 728 |
| $TFS$LWKLL | 729 |
| ETF$DLW$LL | 730 |
| QTF$NLW$LL | 731 |
| $SQE$FSNLWKLL | 732 |

In TABLE 2a, the peptides can comprise an N-terminal capping group such as acetyl or an additional linker such as beta-alanine between the capping group and the start of the peptide sequence.

In some embodiments, peptidomimetic macrocycles include those shown in TABLE 2b:

TABLE 2b

| SP | Sequence | SEQ ID NO: | Exact mass | M + 2 | Observed mass (m/e) |
|---|---|---|---|---|---|
| 1 | Ac-LSQETF$r8DLWKLL$EN-NH$_2$ | 733 | 2068.13 | 1035.07 | 1035.36 |
| 2 | Ac-LSQETF$r8NLWKLL$QN-NH$_2$ | 734 | 2066.16 | 1034.08 | 1034.31 |
| 3 | Ac-LSQQTF$r8NLWRLL$QN-NH$_2$ | 735 | 2093.18 | 1047.59 | 1047.73 |
| 4 | Ac-QSQQTF$r8NLWKLL$QN-NH$_2$ | 736 | 2080.15 | 1041.08 | 1041.31 |
| 5 | Ac-QSQQTF$r8NLWRLL$QN-NH$_2$ | 737 | 2108.15 | 1055.08 | 1055.32 |
| 6 | Ac-QSQQTA$r8NLWRLL$QN-NH$_2$ | 738 | 2032.12 | 1017.06 | 1017.24 |
| 7 | Ac-QAibQQTF$r8NLWRLL$QN-NH$_2$ | 739 | 2106.17 | 1054.09 | 1054.34 |
| 8 | Ac-QSQQTFSNLWRLLPQN-NH$_2$ | 740 | 2000.02 | 1001.01 | 1001.26 |

TABLE 2b-continued

| SP | Sequence | SEQ ID NO: | Exact mass | M + 2 | Observed mass (m/e) |
|---|---|---|---|---|---|
| 9 | Ac-QSQQTF$/r8NLWRLLS/QN-NH₂ | 741 | 2136.18 | 1069.09 | 1069.37 |
| 10 | Ac-QSQAibTF$r8NLWRLL$QN-NH₂ | 742 | 2065.15 | 1033.58 | 1033.71 |
| 11 | Ac-QSQQTF$r8NLWRWAN-NH₂ | 743 | 2051.13 | 1026.57 | 1026.70 |
| 12 | Ac-ASQQTF$r8NLWRLL$QN-NH₂ | 744 | 2051.13 | 1026.57 | 1026.90 |
| 13 | Ac-QSQQTF$r8ALWRLL$QN-NH₂ | 745 | 2065.15 | 1033.58 | 1033.41 |
| 14 | Ac-QSQETF$r8NLWRLL$QN-NH₂ | 746 | 2109.14 | 1055.57 | 1055.70 |
| 15 | Ac-RSQQTF$r8NLWRLL$QN-NH₂ | 747 | 2136.20 | 1069.10 | 1069.17 |
| 16 | Ac-RSQQTF$r8NLWRWEN-NH₂ | 748 | 2137.18 | 1069.59 | 1069.75 |
| 17 | Ac-LSQETFSDLWKLLPEN-NH₂ | 749 | 1959.99 | 981.00 | 981.24 |
| 18 | Ac-QSQ$TFS$LWRLLPQN-NH₂ | 750 | 2008.09 | 1005.05 | 1004.97 |
| 19 | Ac-QSQQ$FSN$WRLLPQN-NH₂ | 751 | 2036.06 | 1019.03 | 1018.86 |
| 20 | Ac-QSQQT$SNL$RLLPQN-NH₂ | 752 | 1917.04 | 959.52 | 959.32 |
| 21 | Ac-QSQQTF$NLW$LLPQN-NH₂ | 753 | 2007.06 | 1004.53 | 1004.97 |
| 22 | Ac-RTQATF$r8NQWAibANle$TNAibTR-NH₂ | 754 | 2310.26 | 1156.13 | 1156.52 |
| 23 | Ac-QSQQTF$r8NLWRLL$RN-NH₂ | 755 | 2136.20 | 1069.10 | 1068.94 |
| 24 | Ac-QSQRTF$r8NLWRLL$QN-NH₂ | 756 | 2136.20 | 1069.10 | 1068.94 |
| 25 | Ac-QSQQTF$r8NNleWRLL$QN-NH₂ | 757 | 2108.15 | 1055.08 | 1055.44 |
| 26 | Ac-QSQQTF$r8NLWRNleL$QN-NH₂ | 758 | 2108.15 | 1055.08 | 1055.84 |
| 27 | Ac-QSQQTF$r8NLWRLNle$QN-NH₂ | 759 | 2108.15 | 1055.08 | 1055.12 |
| 28 | Ac-QSQQTY$r8NLWRLL$QN-NH₂ | 760 | 2124.15 | 1063.08 | 1062.92 |
| 29 | Ac-RAibQQTF$r8NLWRLL$QN-NH₂ | 761 | 2134.22 | 1068.11 | 1068.65 |
| 30 | Ac-MPRFMDYWEGLN-NH₂ | 762 | 1598.70 | 800.35 | 800.45 |
| 31 | Ac-RSQQRF$r8NLWRLL$QN-NH₂ | 763 | 2191.25 | 1096.63 | 1096.83 |
| 32 | Ac-QSQQRF$r8NLWRLL$QN-NH₂ | 764 | 2163.21 | 1082.61 | 1082.87 |
| 33 | Ac-RAibQQRF$r8NLWRLL$QN-NH₂ | 765 | 2189.27 | 1095.64 | 1096.37 |
| 34 | Ac-RSQQRF$r8NFWRLL$QN-NH₂ | 766 | 2225.23 | 1113.62 | 1114.37 |
| 35 | Ac-RSQQRF$r8NYWRLL$QN-NH₂ | 767 | 2241.23 | 1121.62 | 1122.37 |
| 36 | Ac-RSQQTF$r8NLWQLL$QN-NH₂ | 768 | 2108.15 | 1055.08 | 1055.29 |
| 37 | Ac-QSQQTF$r8NLWQAm1L$QN-NH₂ | 769 | 2094.13 | 1048.07 | 1048.32 |
| 38 | Ac-QSQQTF$r8NAm1WRLL$QN-NH₂ | 770 | 2122.17 | 1062.09 | 1062.35 |
| 39 | Ac-NlePRF$r8DYWEGL$QN-NH₂ | 771 | 1869.98 | 935.99 | 936.20 |
| 40 | Ac-NlePRF$r8NYWRLL$QN-NH₂ | 772 | 1952.12 | 977.06 | 977.35 |
| 41 | Ac-RF$r8NLWRLL$Q-NH₂ | 773 | 1577.96 | 789.98 | 790.18 |
| 42 | Ac-QSQQTF$r8N2ffWRLL$QN-NH₂ | 774 | 2160.13 | 1081.07 | 1081.40 |
| 43 | Ac-QSQQTF$r8N3ffWRLL$QN-NH₂ | 775 | 2160.13 | 1081.07 | 1081.34 |
| 44 | Ac-QSQQTF#r8NLWRLL#QN-NH₂ | 776 | 2080.12 | 1041.06 | 1041.34 |
| 45 | Ac-RSQQTA$r8NLWRLL$QN-NH₂ | 777 | 2060.16 | 1031.08 | 1031.38 |
| 46 | Ac-QSQQTF%r8NLWRLL%QN-NH₂ | 778 | 2110.17 | 1056.09 | 1056.55 |

TABLE 2b-continued

| SP | Sequence | SEQ ID NO: | Exact mass | M + 2 | Observed mass (m/e) |
|---|---|---|---|---|---|
| 47 | HepQSQ$TFSNLWRLLPQN-NH₂ | 779 | 2051.10 | 1026.55 | 1026.82 |
| 48 | HepQSQ$TF$r8NLWRLL$QN-NH₂ | 780 | 2159.23 | 1080.62 | 1080.89 |
| 49 | Ac-QSQQTF$r8NL6clWRLL$QN-NH₂ | 781 | 2142.11 | 1072.06 | 1072.35 |
| 50 | Ac-QSQQTF$r8NLMe6clwRLL$QN-NH₂ | 782 | 2156.13 | 1079.07 | 1079.27 |
| 51 | Ac-LTFEHYWAQLTS-NH₂ | 783 | 1535.74 | 768.87 | 768.91 |
| 52 | Ac-LTF$HYWSQLTS-NH₂ | 784 | 1585.83 | 793.92 | 794.17 |
| 53 | Ac-LTFE$YWA$LTS-NH₂ | 785 | 1520.79 | 761.40 | 761.67 |
| 54 | Ac-LTF$zr8HYWAQL$zS-NH₂ | 786 | 1597.87 | 799.94 | 800.06 |
| 55 | Ac-LTF$r8HYWRQL$S-NH₂ | 787 | 1682.93 | 842.47 | 842.72 |
| 56 | Ac-QS$QTFStNLWRLL$s8QN-NH₂ | 788 | 2145.21 | 1073.61 | 1073.90 |
| 57 | Ac-QSQQTASNLWRLLPQN-NH₂ | 789 | 1923.99 | 963.00 | 963.26 |
| 58 | Ac-QSQQTA$/r8NLWRLLVQN-NH₂ | 790 | 2060.15 | 1031.08 | 1031.24 |
| 59 | Ac-ASQQTF$/r8NLWRLLS/QN-NH₂ | 791 | 2079.16 | 1040.58 | 1040.89 |
| 60 | Ac-$SQQ$FSNLWRLLAibQN-NH₂ | 792 | 2009.09 | 1005.55 | 1005.86 |
| 61 | Ac-QS$QTF$NLWRLLAibQN-NH₂ | 793 | 2023.10 | 1012.55 | 1012.79 |
| 62 | Ac-QSQQ$FSN$WRLLAibQN-NH₂ | 794 | 2024.06 | 1013.03 | 1013.31 |
| 63 | Ac-QSQQTF$NLW$LLAibQN-NH₂ | 795 | 1995.06 | 998.53 | 998.87 |
| 64 | Ac-QSQQTFS$LWR$LAibQN-NH₂ | 796 | 2011.06 | 1006.53 | 1006.83 |
| 65 | Ac-QSQQTFSNLW$LLA$N-NH₂ | 797 | 1940.02 | 971.01 | 971.29 |
| 66 | Ac4/SQQ$/FSNLWRLLAibQN-NH₂ | 798 | 2037.12 | 1019.56 | 1019.78 |
| 67 | Ac-QS$/QTFS/NLWRLLAibQN-NH₂ | 799 | 2051.13 | 1026.57 | 1026.90 |
| 68 | Ac-QSQQS/FSNS/WRLLAibQN-NH₂ | 800 | 2052.09 | 1027.05 | 1027.36 |
| 69 | Ac-QSQQTFS/NLW$/LLAibQN-NH₂ | 801 | 2023.09 | 1012.55 | 1013.82 |
| 70 | Ac-QSQ$TFS$LWRLLAibQN-NH₂ | 802 | 1996.09 | 999.05 | 999.39 |
| 71 | Ac-QSQS/TFSS/LWRLLAibQN-NH₂ | 803 | 2024.12 | 1013.06 | 1013.37 |
| 72 | Ac-QS$/QTFSt//NLWRLL$/s8QN-NH₂ | 804 | 2201.27 | 1101.64 | 1102.00 |
| 73 | Ac4r8SQQTFS$LWRLLAibQN-NH₂ | 805 | 2038.14 | 1020.07 | 1020.23 |
| 74 | Ac-QSQ$r8TFSNLW$LLAibQN-NH₂ | 806 | 1996.08 | 999.04 | 999.32 |
| 75 | Ac-QSQQTFS$r8LWRLLA$N-NH₂ | 807 | 2024.12 | 1013.06 | 1013.37 |
| 76 | Ac-QS$r5QTFStNLW$LLAibQN-NH₂ | 808 | 2032.12 | 1017.06 | 1017.39 |
| 77 | Ac-$/r8SQQTFSS/LWRLLAibQN-NH₂ | 809 | 2066.17 | 1034.09 | 1034.80 |
| 78 | Ac-QSQ$/r8TFSNLWS/LLAibQN-NH₂ | 810 | 2024.11 | 1013.06 | 1014.34 |
| 79 | Ac-QSQQTFS$/r8LWRLLAS/N-NH₂ | 811 | 2052.15 | 1027.08 | 1027.16 |
| 80 | Ac-QS$/r5QTFSt//NLWS/LLAibQN-NH₂ | 812 | 2088.18 | 1045.09 | 1047.10 |
| 81 | Ac-QSQQTFSNLWRLLAibQN-NH₂ | 813 | 1988.02 | 995.01 | 995.31 |
| 82 | Hep/QSQS/TF$/r8NLWRLLS/QN-NH₂ | 814 | 2215.29 | 1108.65 | 1108.93 |
| 83 | Ac-ASQQTF$r8NLRWLL$QN-NH₂ | 815 | 2051.13 | 1026.57 | 1026.90 |
| 84 | Ac-QSQQTF$/r8NLWRLLS/Q-NH₂ | 816 | 2022.14 | 1012.07 | 1012.66 |
| 85 | Ac-QSQQTF$r8NLWRLL$Q-NH₂ | 817 | 1994.11 | 998.06 | 998.42 |

TABLE 2b-continued

| SP | Sequence | SEQ ID NO: | Exact mass | M + 2 | Observed mass (m/e) |
|---|---|---|---|---|---|
| 86 | Ac-AAARAA$r8AAARAA$AA-NH₂ | 818 | 1515.90 | 758.95 | 759.21 |
| 87 | Ac-LTFEHYWAQLTSA-NH₂ | 819 | 1606.78 | 804.39 | 804.59 |
| 88 | Ac-LTF$r8HYWAQL$SA-NH₂ | 820 | 1668.90 | 835.45 | 835.67 |
| 89 | Ac-ASQQTFSNLWRLLPQN-NH₂ | 821 | 1943.00 | 972.50 | 973.27 |
| 90 | Ac-QS$QTFStNLW$r5LLAibQN-NH₂ | 822 | 2032.12 | 1017.06 | 1017.30 |
| 91 | Ac-QSQQTFAibNLWRLLAibQN-NH₂ | 823 | 1986.04 | 994.02 | 994.19 |
| 92 | Ac-QSQQTFNleNLWRLLNleQN-NH₂ | 824 | 2042.11 | 1022.06 | 1022.23 |
| 93 | Ac-QSQQTF$/r8NLWRLLAibQN-NH₂ | 825 | 2082.14 | 1042.07 | 1042.23 |
| 94 | Ac-QSQQTF$/r8NLWRLLNleQN-NH₂ | 826 | 2110.17 | 1056.09 | 1056.29 |
| 95 | Ac-QSQQTFAibNLWRLLVQN-NH₂ | 827 | 2040.09 | 1021.05 | 1021.25 |
| 96 | Ac-QSQQTFNleNLWRLL$/QN-NH₂ | 828 | 2068.12 | 1035.06 | 1035.31 |
| 97 | Ac-QSQQTF%r8NL6clWRNleL%QN-NH₂ | 829 | 2144.13 | 1073.07 | 1073.32 |
| 98 | Ac-QSQQTF%r8NLMe6clWRLL%QN-NH₂ | 830 | 2158.15 | 1080.08 | 1080.31 |
| 101 | Ac-FNle$YWE$L-NH₂ | 831 | 1160.63 | — | 1161.70 |
| 102 | Ac-F$r8AYWELL$A-NH₂ | 832 | 1344.75 | — | 1345.90 |
| 103 | Ac-F$r8AYWQLL$A-NH₂ | 833 | 1343.76 | — | 1344.83 |
| 104 | Ac-NlePRF$r8NYWELL$QN-NH₂ | 834 | 1925.06 | 963.53 | 963.69 |
| 105 | Ac-NlePRF$r8DYWRLL$QN-NH₂ | 835 | 1953.10 | 977.55 | 977.68 |
| 106 | Ac-NlePRF$r8NYWRLL$Q-NH₂ | 836 | 1838.07 | 920.04 | 920.18 |
| 107 | Ac-NlePRF$r8NYWRW-NH₂ | 837 | 1710.01 | 856.01 | 856.13 |
| 108 | Ac-QSQQTF$r8DLWRLL$QN-NH₂ | 838 | 2109.14 | 1055.57 | 1055.64 |
| 109 | Ac-QSQQTF$r8NLWRWEN-NH₂ | 839 | 2109.14 | 1055.57 | 1055.70 |
| 110 | Ac-QSQQTF$r8NLWRLL$QD-NH₂ | 840 | 2109.14 | 1055.57 | 1055.64 |
| 111 | Ac-QSQQTF$r8NLWRLL$S-NH₂ | 841 | 1953.08 | 977.54 | 977.60 |
| 112 | Ac-ESQQTF$r8NLWRLL$QN-NH₂ | 842 | 2109.14 | 1055.57 | 1055.70 |
| 113 | Ac-LTF$r8NLWRNleL$Q-NH₂ | 843 | 1635.99 | 819.00 | 819.10 |
| 114 | Ac-LRF$r8NLWRNleL$Q-NH₂ | 844 | 1691.04 | 846.52 | 846.68 |
| 115 | Ac-QSQQTF$r8NWWRNleL$QN-NH₂ | 845 | 2181.15 | 1091.58 | 1091.64 |
| 116 | Ac-QSQQTF$r8NLWRNleL$Q-NH₂ | 846 | 1994.11 | 998.06 | 998.07 |
| 117 | Ac-QTF$r8NLWR1NleL$QN-NH₂ | 847 | 1765.00 | 883.50 | 883.59 |
| 118 | Ac-NlePRF$r8NWWRLL$QN-NH₂ | 848 | 1975.13 | 988.57 | 988.75 |
| 119 | Ac-NlePRF$r8NWWRLL$A-NH₂ | 849 | 1804.07 | 903.04 | 903.08 |
| 120 | Ac-TSFAEYWNLLNH₂ | 850 | 1467.70 | 734.85 | 734.90 |
| 121 | Ac-QTF$r8HWWSQL$S-NH₂ | 851 | 1651.85 | 826.93 | 827.12 |
| 122 | Ac-FM$YWE$L-NH₂ | 852 | 1178.58 | — | 1179.64 |
| 123 | Ac-QTFEHWWSQLLS-NH₂ | 853 | 1601.76 | 801.88 | 801.94 |
| 124 | Ac-QSQQTF$r8NLAmwRLNle$QN-NH₂ | 854 | 2122.17 | 1062.09 | 1062.24 |
| 125 | Ac-FMAibY6clWEAc3cL-NH₂ | 855 | 1130.47 | — | 1131.53 |

TABLE 2b-continued

| SP | Sequence | SEQ ID NO: | Exact mass | M + 2 | Observed mass (m/e) |
|---|---|---|---|---|---|
| 126 | Ac-FNle$Y6clWE$L-NH$_2$ | 856 | 1194.59 | — | 1195.64 |
| 127 | Ac-F$zr8AY6clWEAc3cL$z-NH$_2$ | 857 | 1277.63 | 639.82 | 1278.71 |
| 128 | Ac-F$r8AY6clWEAc3cL$A-NH$_2$ | 858 | 1348.66 | — | 1350.72 |
| 129 | Ac-NlePRF$r8NY6clWRLL$QN-NH$_2$ | 859 | 1986.08 | 994.04 | 994.64 |
| 130 | Ac-AF$r8AAWALA$A-NH$_2$ | 860 | 1223.71 | — | 1224.71 |
| 131 | Ac-TF$r8AAWRLA$Q-NH$_2$ | 861 | 1395.80 | 698.90 | 399.04 |
| 132 | Pr-TF$r8AAWRLA$Q-NH$_2$ | 862 | 1409.82 | 705.91 | 706.04 |
| 133 | Ac-QSQQTF%r8NLWRNleL%QN-NH$_2$ | 863 | 2110.17 | 1056.09 | 1056.22 |
| 134 | Ac-LTF%r8HYWAQL%SA-NH$_2$ | 864 | 1670.92 | 836.46 | 836.58 |
| 135 | Ac-NlePRF%r8NYWRLL%QN-NH$_2$ | 865 | 1954.13 | 978.07 | 978.19 |
| 136 | Ac-NlePRF%r8NY6clWRLL%QN-NH$_2$ | 866 | 1988.09 | 995.05 | 995.68 |
| 137 | Ac-LTF%r8HY6clWAQL%S-NH$_2$ | 867 | 1633.84 | 817.92 | 817.93 |
| 138 | Ac-QS%QTF%StNLWRLL%s8QN-NH$_2$ | 868 | 2149.24 | 1075.62 | 1075.65 |
| 139 | Ac-LTF%r8HY6clWRQL%S-NH$_2$ | 869 | 1718.91 | 860.46 | 860.54 |
| 140 | Ac-QSQQTF%r8NL6clWRLL%QN-NH$_2$ | 870 | 2144.13 | 1073.07 | 1073.64 |
| 141 | Ac-%r8SQQTFS%LWRLLAibQN-NH$_2$ | 871 | 2040.15 | 1021.08 | 1021.13 |
| 142 | Ac-LTF%r8HYWAQL%S-NH$_2$ | 872 | 1599.88 | 800.94 | 801.09 |
| 143 | Ac-TSF%r8QYWNLL%P-NH$_2$ | 873 | 1602.88 | 802.44 | 802.58 |
| 147 | Ac-LTFEHYWAQLTS-NH$_2$ | 874 | 1535.74 | 768.87 | 769.5 |
| 152 | Ac-F$er8AY6clWEAc3cL$e-NH$_2$ | 875 | 1277.63 | 639.82 | 1278.71 |
| 153 | Ac-AF$r8AAWALA$A-NH$_2$ | 876 | 1277.63 | 639.82 | 1277.84 |
| 154 | Ac-TF$r8AAWRLA$Q-NH$_2$ | 877 | 1395.80 | 698.90 | 699.04 |
| 155 | Pr-TF$r8AAWRLA$Q-NH$_2$ | 878 | 1409.82 | 705.91 | 706.04 |
| 156 | Ac-LTF$er8HYWAQMS-NH$_2$ | 879 | 1597.87 | 799.94 | 800.44 |
| 159 | Ac-CCPGCCBaQSQQTF$r8NLWRLL$QN-NH$_2$ | 880 | 2745.30 | 1373.65 | 1372.99 |
| 160 | Ac-CCPGCCBaQSQQTA$r8NLWRLL$QN-NH$_2$ | 881 | 2669.27 | 1335.64 | 1336.09 |
| 161 | Ac-CCPGCCBaNlePRF$r8NYWRLL$QN-NH$_2$ | 882 | 2589.26 | 1295.63 | 1296.2 |
| 162 | Ac-LTF$/r8HYWAQLS/S-NH$_2$ | 883 | 1625.90 | 813.95 | 814.18 |
| 163 | Ac-F%r8HY6clWRAc3cL%-NH$_2$ | 884 | 1372.72 | 687.36 | 687.59 |
| 164 | Ac-QTF%r8HWWSQL%S-NH$_2$ | 885 | 1653.87 | 827.94 | 827.94 |
| 165 | Ac-LTA$r8HYWRQL$S-NH$_2$ | 886 | 1606.90 | 804.45 | 804.66 |
| 166 | Ac-Q$r8QQTFSN$WRLLAibQN-NH$_2$ | 887 | 2080.12 | 1041.06 | 1041.61 |
| 167 | Ac-QSQQ$r8FSNLWR$LAibQN-NH$_2$ | 888 | 2066.11 | 1034.06 | 1034.58 |
| 168 | Ac-F$r8AYWEAc3cL$A-NH$_2$ | 889 | 1314.70 | 658.35 | 1315.88 |
| 169 | Ac-F$r8AYWEAc3cL$S-NH$_2$ | 890 | 1330.70 | 666.35 | 1331.87 |
| 170 | Ac-F$r8AYWEAc3cL$Q-NH$_2$ | 891 | 1371.72 | 686.86 | 1372.72 |
| 171 | Ac-F$r8AYWEAibL$S-NH$_2$ | 892 | 1332.71 | 667.36 | 1334.83 |
| 172 | Ac-F$r8AYWEAL$S-NI-12 | 893 | 1318.70 | 660.35 | 1319.73 |
| 173 | Ac-F$r8AYWEQL$S-NH$_2$ | 894 | 1375.72 | 688.86 | 1377.53 |

TABLE 2b-continued

| SP | Sequence | SEQ ID NO: | Exact mass | M + 2 | Observed mass (m/e) |
|---|---|---|---|---|---|
| 174 | Ac-F$r8HYWEQL$S-NH$_2$ | 895 | 1441.74 | 721.87 | 1443.48 |
| 175 | Ac-F$r8HYWAQL$S-NH$_2$ | 896 | 1383.73 | 692.87 | 1385.38 |
| 176 | Ac-F$r8HYWAAc3cL$S-NH$_2$ | 897 | 1338.71 | 670.36 | 1340.82 |
| 177 | Ac-F$r8HYWRAc3cL$S-NH$_2$ | 898 | 1423.78 | 712.89 | 713.04 |
| 178 | Ac-F$r8AYWEAc3cL#A-NH$_2$ | 899 | 1300.69 | 651.35 | 1302.78 |
| 179 | Ac-NlePTF%r8NYWRLL%QN-NH$_2$ | 900 | 1899.08 | 950.54 | 950.56 |
| 180 | Ac-TF$r8AAWRAL$Q-NH$_2$ | 901 | 1395.80 | 698.90 | 699.13 |
| 181 | Ac-TSF%r8HYWAQL%S-NH$_2$ | 902 | 1573.83 | 787.92 | 787.98 |
| 184 | Ac-F%r8AY6clWEAc3cL%A-NH$_2$ | 903 | 1350.68 | 676.34 | 676.91 |
| 185 | Ac-LTF$r8HYWAQI$S-NH$_2$ | 904 | 1597.87 | 799.94 | 800.07 |
| 186 | Ac-LTF$r8HYWAQNle$S-NH$_2$ | 905 | 1597.87 | 799.94 | 800.07 |
| 187 | Ac-LTF$r8HYWAQL$A-NH$_2$ | 906 | 1581.87 | 791.94 | 792.45 |
| 188 | Ac-LTF$r8HYWAQL$Abu-NH$_2$ | 907 | 1595.89 | 798.95 | 799.03 |
| 189 | Ac-LTF$r8HYWAbuQL$S-NH$_2$ | 908 | 1611.88 | 806.94 | 807.47 |
| 190 | Ac-LTF$er8AYWAQMS-NI-12 | 909 | 1531.84 | 766.92 | 766.96 |
| 191 | Ac-LAF$r8HYWAQL$S-NH$_2$ | 910 | 1567.86 | 784.93 | 785.49 |
| 192 | Ac-LAF$r8AYWAQL$S-NH$_2$ | 911 | 1501.83 | 751.92 | 752.01 |
| 193 | Ac-LTF$er8AYWAQL$eA-NH$_2$ | 912 | 1515.85 | 758.93 | 758.97 |
| 194 | Ac-LAF$r8AYWAQL$A-NH$_2$ | 913 | 1485.84 | 743.92 | 744.05 |
| 195 | Ac-LTF$r8NLWANleL$Q-NH$_2$ | 914 | 1550.92 | 776.46 | 776.61 |
| 196 | Ac-LTF$r8NLWANleL$A-NH$_2$ | 915 | 1493.90 | 747.95 | 1495.6 |
| 197 | Ac-LTF$r8ALWANleL$Q-NH$_2$ | 916 | 1507.92 | 754.96 | 755 |
| 198 | Ac-LAF$r8NLWANleL$Q-NH$_2$ | 917 | 1520.91 | 761.46 | 761.96 |
| 199 | Ac-LAF$r8ALWANleL$A-NH$_2$ | 918 | 1420.89 | 711.45 | 1421.74 |
| 200 | Ac-A$r8AYWEAc3cL$A-NH$_2$ | 919 | 1238.67 | 620.34 | 1239.65 |
| 201 | Ac-F$r8AYWEAc3cL$AA-NH$_2$ | 920 | 1385.74 | 693.87 | 1386.64 |
| 202 | Ac-F$r8AYWEAc3cL$Abu-NH$_2$ | 921 | 1328.72 | 665.36 | 1330.17 |
| 203 | Ac-F$r8AYWEAc3cL$Nle-NH$_2$ | 922 | 1356.75 | 679.38 | 1358.22 |
| 204 | Ac-F$r5AYWEAc3cL$s8A-NH$_2$ | 923 | 1314.70 | 658.35 | 1315.51 |
| 205 | Ac-F$AYWEAc3cL$r8A-NH$_2$ | 924 | 1314.70 | 658.35 | 1315.66 |
| 206 | Ac-F$r8AYWEAc3cI$A-NH$_2$ | 925 | 1314.70 | 658.35 | 1316.18 |
| 207 | Ac-F$r8AYWEAc3cNle$A-NH$_2$ | 926 | 1314.70 | 658.35 | 1315.66 |
| 208 | Ac-F$r8AYWEAm1L$A-NH$_2$ | 927 | 1358.76 | 680.38 | 1360.21 |
| 209 | Ac-F$r8AYWENleL$A-NH$_2$ | 928 | 1344.75 | 673.38 | 1345.71 |
| 210 | Ac-F$r8AYWQAc3cL$A-NH$_2$ | 929 | 1313.72 | 657.86 | 1314.7 |
| 211 | Ac-F$r8AYWAAc3cL$A-NH$_2$ | 930 | 1256.70 | 629.35 | 1257.56 |
| 212 | Ac-F$r8AYWAbuAc3cL$A-NH$_2$ | 931 | 1270.71 | 636.36 | 1272.14 |
| 213 | Ac-F$r8AYWNleAc3cL$A-NH$_2$ | 932 | 1298.74 | 650.37 | 1299.67 |

TABLE 2b-continued

| SP | Sequence | SEQ ID NO: | Exact mass | M + 2 | Observed mass (m/e) |
|---|---|---|---|---|---|
| 214 | Ac-F$r8AbuYWEAc3cL$A-NH₂ | 933 | 1328.72 | 665.36 | 1329.65 |
| 215 | Ac-F$r8NleYWEAc3cL$A-NH₂ | 934 | 1356.75 | 679.38 | 1358.66 |
| 216 | 5-FAM-BaLTFEHYWAQLTS-NH₂ | 935 | 1922.82 | 962.41 | 962.87 |
| 217 | 5-FAM-BaLTF%r8HYWAQL%S-NH₂ | 936 | 1986.96 | 994.48 | 994.97 |
| 218 | Ac-LTF$r8HYWAQhL$S-NH₂ | 937 | 1611.88 | 806.94 | 807 |
| 219 | Ac-LTF$r8HYWAQT1e$S-NH₂ | 938 | 1597.87 | 799.94 | 799.97 |
| 220 | Ac-LTF$r8HYWAQAdm$S-NH₂ | 939 | 1675.91 | 838.96 | 839.09 |
| 221 | Ac-LTF$r8HYWAQhCha$S-NH₂ | 940 | 1651.91 | 826.96 | 826.98 |
| 222 | Ac-LTF$r8HYWAQCha$S-NH₂ | 941 | 1637.90 | 819.95 | 820.02 |
| 223 | Ac-LTF$r8HYWAc6cQL$S-NH₂ | 942 | 1651.91 | 826.96 | 826.98 |
| 224 | Ac-LTF$r8HYWAc5cQL$S-NH₂ | 943 | 1637.90 | 819.95 | 820.02 |
| 225 | Ac-LThF$r8HYWAQL$S-NH₂ | 944 | 1611.88 | 806.94 | 807 |
| 226 | Ac-LTIg1$r8HYWAQL$S-NH₂ | 945 | 1625.90 | 813.95 | 812.99 |
| 227 | Ac-LTF$r8HYWAQChg$S-NH₂ | 946 | 1623.88 | 812.94 | 812.99 |
| 228 | Ac-LTF$r8HYWAQF$S-NH₂ | 947 | 1631.85 | 816.93 | 816.99 |
| 229 | Ac-LTF$r8HYWAQIg1$S-NH₂ | 948 | 1659.88 | 830.94 | 829.94 |
| 230 | Ac-LTF$r8HYWAQCba$S-NH₂ | 949 | 1609.87 | 805.94 | 805.96 |
| 231 | Ac-LTF$r8HYWAQCpg$S-NH₂ | 950 | 1609.87 | 805.94 | 805.96 |
| 232 | Ac-LTF$r8HhYWAQL$S-NH₂ | 951 | 1611.88 | 806.94 | 807 |
| 233 | Ac-F$r8AYWEAc3chL$A-NH₂ | 952 | 1328.72 | 665.36 | 665.43 |
| 234 | Ac-F$r8AYWEAc3cT1e$A-NH₂ | 953 | 1314.70 | 658.35 | 1315.62 |
| 235 | Ac-F$r8AYWEAc3cAdm$A-NH₂ | 954 | 1392.75 | 697.38 | 697.47 |
| 236 | Ac-F$r8AYWEAc3chCha$A-NH₂ | 955 | 1368.75 | 685.38 | 685.34 |
| 237 | Ac-F$r8AYWEAc3cCha$A-NH₂ | 956 | 1354.73 | 678.37 | 678.38 |
| 238 | Ac-F$r8AYWEAc6cL$A-NH₂ | 957 | 1356.75 | 679.38 | 679.42 |
| 239 | Ac-F$r8AYWEAc5cL$A-NH₂ | 958 | 1342.73 | 672.37 | 672.46 |
| 240 | Ac-hF$r8AYWEAc3cL$A-NH₂ | 959 | 1328.72 | 665.36 | 665.43 |
| 241 | Ac-Ig1$r8AYWEAc3cL$A-NH₂ | 960 | 1342.73 | 672.37 | 671.5 |
| 243 | Ac-F$r8AYWEAc3cF$A-NH₂ | 961 | 1348.69 | 675.35 | 675.35 |
| 244 | Ac-F$r8AYWEAc3cIg1$A-NH₂ | 962 | 1376.72 | 689.36 | 688.37 |
| 245 | Ac-F$r8AYWEAc3cCba$A-NH₂ | 963 | 1326.70 | 664.35 | 664.47 |
| 246 | Ac-F$r8AYWEAc3cCpg$A-NH₂ | 964 | 1326.70 | 664.35 | 664.39 |
| 247 | Ac-F$r8AhYWEAc3cL$A-NH₂ | 965 | 1328.72 | 665.36 | 665.43 |
| 248 | Ac-F$r8AYWEAc3cL$Q-NH₂ | 966 | 1371.72 | 686.86 | 1372.87 |
| 249 | Ac-F$r8AYWEAibL$A-NH₂ | 967 | 1316.72 | 659.36 | 1318.18 |
| 250 | Ac-F$r8AYWEAL$A-NH₂ | 968 | 1302.70 | 652.35 | 1303.75 |
| 251 | Ac-LAF$r8AYWAAL$A-NH₂ | 969 | 1428.82 | 715.41 | 715.49 |
| 252 | Ac-LTF$r8HYWAAc3cL$S-NH₂ | 970 | 1552.84 | 777.42 | 777.5 |
| 253 | Ac-NleTF$r8HYWAQL$S-NH₂ | 971 | 1597.87 | 799.94 | 800.04 |

TABLE 2b-continued

| SP | Sequence | SEQ ID NO: | Exact mass | M + 2 | Observed mass (m/e) |
|---|---|---|---|---|---|
| 254 | Ac-VTF$r8HYWAQL$S-NH₂ | 972 | 1583.85 | 792.93 | 793.04 |
| 255 | Ac-FTF$r8HYWAQL$S-NH₂ | 973 | 1631.85 | 816.93 | 817.02 |
| 256 | Ac-WTF$r8HYWAQL$S-NH₂ | 974 | 1670.86 | 836.43 | 836.85 |
| 257 | Ac-RTF$r8HYWAQL$S-NH₂ | 975 | 1640.88 | 821.44 | 821.9 |
| 258 | Ac-KTF$r8HYWAQL$S-NH₂ | 976 | 1612.88 | 807.44 | 807.91 |
| 259 | Ac-LNleF$r8HYWAQL$S-NH₂ | 977 | 1609.90 | 805.95 | 806.43 |
| 260 | Ac-LVF$r8HYWAQL$S-NH₂ | 978 | 1595.89 | 798.95 | 798.93 |
| 261 | Ac-LFF$r8HYWAQL$S-NH₂ | 979 | 1643.89 | 822.95 | 823.38 |
| 262 | Ac-LWF$r8HYWAQL$S-NH₂ | 980 | 1682.90 | 842.45 | 842.55 |
| 263 | Ac-LRF$r8HYWAQL$S-NH₂ | 981 | 1652.92 | 827.46 | 827.52 |
| 264 | Ac-LKF$r8HYWAQL$S-NH₂ | 982 | 1624.91 | 813.46 | 813.51 |
| 265 | Ac-LTF$r8NleYWAQL$S-NH₂ | 983 | 1573.89 | 787.95 | 788.05 |
| 266 | Ac-LTF$r8VYWAQL$S-NH₂ | 984 | 1559.88 | 780.94 | 780.98 |
| 267 | Ac-LTF$r8FYWAQL$S-NH₂ | 985 | 1607.88 | 804.94 | 805.32 |
| 268 | Ac-LTF$r8WYWAQL$S-NH₂ | 986 | 1646.89 | 824.45 | 824.86 |
| 269 | Ac-LTF$r8RYWAQL$S-NH₂ | 987 | 1616.91 | 809.46 | 809.51 |
| 270 | Ac-LTF$r8KYWAQL$S-NH₂ | 988 | 1588.90 | 795.45 | 795.48 |
| 271 | Ac-LTF$r8HNleWAQL$S-NH₂ | 989 | 1547.89 | 774.95 | 774.98 |
| 272 | Ac-LTF$r8HVWAQL$S-NH₂ | 990 | 1533.87 | 767.94 | 767.95 |
| 273 | Ac-LTF$r8HFWAQL$S-NH₂ | 991 | 1581.87 | 791.94 | 792.3 |
| 274 | Ac-LTF$r8HWWAQL$S-NH₂ | 992 | 1620.88 | 811.44 | 811.54 |
| 275 | Ac-LTF$r8HRWAQL$S-NH₂ | 993 | 1590.90 | 796.45 | 796.52 |
| 276 | Ac-LTF$r8HKWAQL$S-NH₂ | 994 | 1562.90 | 782.45 | 782.53 |
| 277 | Ac-LTF$r8HYWNleQL$S-NH₂ | 995 | 1639.91 | 820.96 | 820.98 |
| 278 | Ac-LTF$r8HYWVQL$S-NH₂ | 996 | 1625.90 | 813.95 | 814.03 |
| 279 | Ac-LTF$r8HYWFQL$S-NH₂ | 997 | 1673.90 | 837.95 | 838.03 |
| 280 | Ac-LTF$r8HYWWQL$S-NH₂ | 998 | 1712.91 | 857.46 | 857.5 |
| 281 | Ac-LTF$r8HYWKQL$S-NH₂ | 999 | 1654.92 | 828.46 | 828.49 |
| 282 | Ac-LTF$r8HYWANleL$S-NH₂ | 1000 | 1582.89 | 792.45 | 792.52 |
| 283 | Ac-LTF$r8HYWAVL$S-NH₂ | 1001 | 1568.88 | 785.44 | 785.49 |
| 284 | Ac-LTF$r8HYWAFL$S-NH₂ | 1002 | 1616.88 | 809.44 | 809.47 |
| 285 | Ac-LTF$r8HYWAWL$S-NH₂ | 1003 | 1655.89 | 828.95 | 829 |
| 286 | Ac-LTF$r8HYWARL$S-NH₂ | 1004 | 1625.91 | 813.96 | 813.98 |
| 287 | Ac-LTF$r8HYWAQL$Nle-NH₂ | 1005 | 1623.92 | 812.96 | 813.39 |
| 288 | Ac-LTF$r8HYWAQL$V-NH₂ | 1006 | 1609.90 | 805.95 | 805.99 |
| 289 | Ac-LTF$r8HYWAQL$F-NH₂ | 1007 | 1657.90 | 829.95 | 830.26 |
| 290 | Ac-LTF$r8HYWAQL$W-NH₂ | 1008 | 1696.91 | 849.46 | 849.5 |
| 291 | Ac-LTF$r8HYWAQL$R-NH₂ | 1009 | 1666.94 | 834.47 | 834.56 |

TABLE 2b-continued

| SP | Sequence | SEQ ID NO: | Exact mass | M + 2 | Observed mass (m/e) |
|---|---|---|---|---|---|
| 292 | Ac-LTF$r8HYWAQL$K-NH₂ | 1010 | 1638.93 | 820.47 | 820.49 |
| 293 | Ac-Q$r8QQTFSN$WRLLAibQN-NH₂ | 1011 | 2080.12 | 1041.06 | 1041.54 |
| 294 | Ac-QSQQ$r8FSNLWR$LAibQN-NH₂ | 1012 | 2066.11 | 1034.06 | 1034.58 |
| 295 | Ac-LT2Pa1$r8HYWAQL$S-NH₂ | 1013 | 1598.86 | 800.43 | 800.49 |
| 296 | Ac-LT3Pa1$r8HYWAQL$S-NH₂ | 1014 | 1598.86 | 800.43 | 800.49 |
| 297 | Ac-LT4Pa1$r8HYWAQL$S-NH₂ | 1015 | 1598.86 | 800.43 | 800.49 |
| 298 | Ac-LTF2CF3Sr8HYWAQL$S-NH₂ | 1016 | 1665.85 | 833.93 | 834.01 |
| 299 | Ac-LTF2CN$r8HYWAQL$S-NH₂ | 1017 | 1622.86 | 812.43 | 812.47 |
| 300 | Ac-LTF2Me$r8HYWAQL$S-NH₂ | 1018 | 1611.88 | 806.94 | 807 |
| 301 | Ac-LTF3Cl$r8HYWAQL$S-NH₂ | 1019 | 1631.83 | 816.92 | 816.99 |
| 302 | Ac-LTF4CF3Sr8HYWAQL$S-NH₂ | 1020 | 1665.85 | 833.93 | 833.94 |
| 303 | Ac-LTF4tBar8HYWAQL$S-NH₂ | 1021 | 1653.93 | 827.97 | 828.02 |
| 304 | Ac-LTF5F$r8HYWAQL$S-NH₂ | 1022 | 1687.82 | 844.91 | 844.96 |
| 305 | Ac-LTF$r8HY3BthAAQL$S-NH₂ | 1023 | 1614.83 | 808.42 | 808.48 |
| 306 | Ac-LTF2Br$r8HYWAQL$S-NH₂ | 1024 | 1675.78 | 838.89 | 838.97 |
| 307 | Ac-LTF4Br$r8HYWAQL$S-NH₂ | 1025 | 1675.78 | 838.89 | 839.86 |
| 308 | Ac-LTF2Cl$r8HYWAQL$S-NH₂ | 1026 | 1631.83 | 816.92 | 816.99 |
| 309 | Ac-LTF4Cl$r8HYWAQL$S-NH₂ | 1027 | 1631.83 | 816.92 | 817.36 |
| 310 | Ac-LTF3CN$r8HYWAQL$S-NH₂ | 1028 | 1622.86 | 812.43 | 812.47 |
| 311 | Ac-LTF4CN$r8HYWAQL$S-NH₂ | 1029 | 1622.86 | 812.43 | 812.47 |
| 312 | Ac-LTF34C12$r8HYWAQL$S-NH₂ | 1030 | 1665.79 | 833.90 | 833.94 |
| 313 | Ac-LTF34F2$r8HYWAQL$S-NH₂ | 1031 | 1633.85 | 817.93 | 817.95 |
| 314 | Ac-LTF35F2$r8HYWAQL$S-NH₂ | 1032 | 1633.85 | 817.93 | 817.95 |
| 315 | Ac-LTDip$r8HYWAQL$S-NH₂ | 1033 | 1673.90 | 837.95 | 838.01 |
| 316 | Ac-LTF2F$r8HYWAQL$S-NH₂ | 1034 | 1615.86 | 808.93 | 809 |
| 317 | Ac-LTF3F$r8HYWAQL$S-NH₂ | 1035 | 1615.86 | 808.93 | 809 |
| 318 | Ac-LTF4F$r8HYWAQL$S-NH₂ | 1036 | 1615.86 | 808.93 | 809 |
| 319 | Ac-LTF4M8HYWAQL$S-NH₂ | 1037 | 1723.76 | 862.88 | 862.94 |
| 320 | Ac-LTF3Me$r8HYWAQL$S-NH₂ | 1038 | 1611.88 | 806.94 | 807.07 |
| 321 | Ac-LTF4Me$r8HYWAQL$S-NH₂ | 1039 | 1611.88 | 806.94 | 807 |
| 322 | Ac-LT1Nal$r8HYWAQL$S-NH₂ | 1040 | 1647.88 | 824.94 | 824.98 |
| 323 | Ac-LT2Nal$r8HYWAQL$S-NH₂ | 1041 | 1647.88 | 824.94 | 825.06 |
| 324 | Ac-LTF3CF3Sr8HYWAQL$S-NH₂ | 1042 | 1665.85 | 833.93 | 834.01 |
| 325 | Ac-LTF4NO2$r8HYWAQL$S-NH₂ | 1043 | 1642.85 | 822.43 | 822.46 |
| 326 | Ac-LTF3NO2$r8HYWAQL$S-NH₂ | 1044 | 1642.85 | 822.43 | 822.46 |
| 327 | Ac-LTF$r82ThiYWAQL$S-NH₂ | 1045 | 1613.83 | 807.92 | 807.96 |
| 328 | Ac-LTF$r8HBipWAQL$S-NH₂ | 1046 | 1657.90 | 829.95 | 830.01 |
| 329 | Ac-LTF$r8HF4tBuWAQL$S-NH₂ | 1047 | 1637.93 | 819.97 | 820.02 |
| 330 | Ac-LTF$r8HF4CF3WAQL$S-NH₂ | 1048 | 1649.86 | 825.93 | 826.02 |

TABLE 2b-continued

| SP | Sequence | SEQ ID NO: | Exact mass | M + 2 | Observed mass (m/e) |
|---|---|---|---|---|---|
| 331 | Ac-LTF$r8HF4ClWAQL$S-NH$_2$ | 1049 | 1615.83 | 808.92 | 809.37 |
| 332 | Ac-LTF$r8HF4MeWAQL$S-NH$_2$ | 1050 | 1595.89 | 798.95 | 799.01 |
| 333 | Ac-LTF$r8HF4BrWAQL$S-NH$_2$ | 1051 | 1659.78 | 830.89 | 830.98 |
| 334 | Ac-LTF$r8HF4CNWAQL$S-NH$_2$ | 1052 | 1606.87 | 804.44 | 804.56 |
| 335 | Ac-LTF$r8HF4NO2WAQL$S-NH$_2$ | 1053 | 1626.86 | 814.43 | 814.55 |
| 336 | Ac-LTF$r8H1NalWAQL$S-NH$_2$ | 1054 | 1631.89 | 816.95 | 817.06 |
| 337 | Ac-LTF$r8H2NalWAQL$S-NH$_2$ | 1055 | 1631.89 | 816.95 | 816.99 |
| 338 | Ac-LTF$r8HWAQL$S-NH$_2$ | 1056 | 1434.80 | 718.40 | 718.49 |
| 339 | Ac-LTF$r8HY1NalAQL$S-NH$_2$ | 1057 | 1608.87 | 805.44 | 805.52 |
| 340 | Ac-LTF$r8HY2NalAQL$S-NH$_2$ | 1058 | 1608.87 | 805.44 | 805.52 |
| 341 | Ac-LTF$r8HYWAQI$S-NH$_2$ | 1059 | 1597.87 | 799.94 | 800.07 |
| 342 | Ac-LTF$r8HYWAQNle$S-NH$_2$ | 1060 | 1597.87 | 799.94 | 800.44 |
| 343 | Ac-LTF$er8HYWAQL$eA-NH$_2$ | 1061 | 1581.87 | 791.94 | 791.98 |
| 344 | Ac-LTF$r8HYWAQL$Abu-NH$_2$ | 1062 | 1595.89 | 798.95 | 799.03 |
| 345 | Ac-LTF$r8HYWAbuQL$S-NH$_2$ | 1063 | 1611.88 | 806.94 | 804.47 |
| 346 | Ac-LAM8HYWAQL$S-NH$_2$ | 1064 | 1567.86 | 784.93 | 785.49 |
| 347 | Ac-LTF$r8NLWANleL$Q-NH$_2$ | 1065 | 1550.92 | 776.46 | 777.5 |
| 348 | Ac-LTF$r8ALWANleL$Q-NH$_2$ | 1066 | 1507.92 | 754.96 | 755.52 |
| 349 | Ac-LAF$r8NLWANleL$Q-NH$_2$ | 1067 | 1520.91 | 761.46 | 762.48 |
| 350 | Ac-F$r8AYWAAc3cL$A-NH$_2$ | 1068 | 1256.70 | 629.35 | 1257.56 |
| 351 | Ac-LTF$r8AYWAAL$S-NH$_2$ | 1069 | 1474.82 | 738.41 | 738.55 |
| 352 | Ac-LVF$r8AYWAQL$S-NH$_2$ | 1070 | 1529.87 | 765.94 | 766 |
| 353 | Ac-LTF$r8AYWAbuQL$S-NH$_2$ | 1071 | 1545.86 | 773.93 | 773.92 |
| 354 | Ac-LTF$r8AYWNleQL$S-NH$_2$ | 1072 | 1573.89 | 787.95 | 788.17 |
| 355 | Ac-LTF$r8AbuYWAQL$S-NH$_2$ | 1073 | 1545.86 | 773.93 | 773.99 |
| 356 | Ac-LTF$r8AYWHQL$S-NH$_2$ | 1074 | 1597.87 | 799.94 | 799.97 |
| 357 | Ac-LTF$r8AYWKQL$S-NH$_2$ | 1075 | 1588.90 | 795.45 | 795.53 |
| 358 | Ac-LTF$r8AYWOQL$S-NH$_2$ | 1076 | 1574.89 | 788.45 | 788.5 |
| 359 | Ac-LTF$r8AYWRQL$S-NH$_2$ | 1077 | 1616.91 | 809.46 | 809.51 |
| 360 | Ac-LTF$r8AYWSQL$S-NH$_2$ | 1078 | 1547.84 | 774.92 | 774.96 |
| 361 | Ac-LTF$r8AYWRAL$S-NH$_2$ | 1079 | 1559.89 | 780.95 | 780.95 |
| 362 | Ac-LTF$r8AYWRQL$A-NH$_2$ | 1080 | 1600.91 | 801.46 | 801.52 |
| 363 | Ac-LTF$r8AYWRAL$A-NH$_2$ | 1081 | 1543.89 | 772.95 | 773.03 |
| 364 | Ac-LTF$r5HYWAQL$s8S-NH$_2$ | 1082 | 1597.87 | 799.94 | 799.97 |
| 365 | Ac-LTF$HYWAQL$r8S-NH$_2$ | 1083 | 1597.87 | 799.94 | 799.97 |
| 366 | Ac-LTF$r8HYWAAL$S-NH$_2$ | 1084 | 1540.84 | 771.42 | 771.48 |
| 367 | Ac-LTF$r8HYWAAbuL$S-NH$_2$ | 1085 | 1554.86 | 778.43 | 778.51 |
| 368 | Ac-LTF$r8HYWALL$S-NH$_2$ | 1086 | 1582.89 | 792.45 | 792.49 |

TABLE 2b-continued

| SP | Sequence | SEQ ID NO: | Exact mass | M + 2 | Observed mass (m/e) |
|---|---|---|---|---|---|
| 369 | Ac-F$r8AYWHAL$A-NH$_2$ | 1087 | 1310.72 | 656.36 | 656.4 |
| 370 | Ac-F$r8AYWAAL$A-NH$_2$ | 1088 | 1244.70 | 623.35 | 1245.61 |
| 371 | Ac-F$r8AYWSAL$A-NH$_2$ | 1089 | 1260.69 | 631.35 | 1261.6 |
| 372 | Ac-F$r8AYWRAL$A-NH$_2$ | 1090 | 1329.76 | 665.88 | 1330.72 |
| 373 | Ac-F$r8AYWKAL$A-NH$_2$ | 1091 | 1301.75 | 651.88 | 1302.67 |
| 374 | Ac-F$r8AYWOAL$A-NH$_2$ | 1092 | 1287.74 | 644.87 | 1289.13 |
| 375 | Ac-F$r8VYWEAc3cL$A-NH$_2$ | 1093 | 1342.73 | 672.37 | 1343.67 |
| 376 | Ac-F$r8FYWEAc3cL$A-NH$_2$ | 1094 | 1390.73 | 696.37 | 1392.14 |
| 377 | Ac-F$r8WYWEAc3cL$A-NH$_2$ | 1095 | 1429.74 | 715.87 | 1431.44 |
| 378 | Ac-F$r8RYWEAc3cL$A-NH$_2$ | 1096 | 1399.77 | 700.89 | 700.95 |
| 379 | Ac-F$r8KYWEAc3cL$A-NH$_2$ | 1097 | 1371.76 | 686.88 | 686.97 |
| 380 | Ac-F$r8ANleWEAc3cL$A-NH$_2$ | 1098 | 1264.72 | 633.36 | 1265.59 |
| 381 | Ac-F$r8AVWEAc3cL$A-NH$_2$ | 1099 | 1250.71 | 626.36 | 1252.2 |
| 382 | Ac-F$r8AFWEAc3cL$A-NH$_2$ | 1100 | 1298.71 | 650.36 | 1299.64 |
| 383 | Ac-F$r8AWWEAc3cL$A-NH$_2$ | 1101 | 1337.72 | 669.86 | 1338.64 |
| 384 | Ac-F$r8ARWEAc3cL$A-NH$_2$ | 1102 | 1307.74 | 654.87 | 655 |
| 385 | Ac-F$r8AKWEAc3cL$A-NH$_2$ | 1103 | 1279.73 | 640.87 | 641.01 |
| 386 | Ac-F$r8AYWVAc3cL$A-NH$_2$ | 1104 | 1284.73 | 643.37 | 643.38 |
| 387 | Ac-F$r8AYWFAc3cL$A-NH$_2$ | 1105 | 1332.73 | 667.37 | 667.43 |
| 388 | Ac-F$r8AYWWAc3cL$A-NH$_2$ | 1106 | 1371.74 | 686.87 | 686.97 |
| 389 | Ac-F$r8AYWRAc3cL$A-NH$_2$ | 1107 | 1341.76 | 671.88 | 671.94 |
| 390 | Ac-F$r8AYWKAc3cL$A-NH$_2$ | 1108 | 1313.75 | 657.88 | 657.88 |
| 391 | Ac-F$r8AYWEVL$A-NH$_2$ | 1109 | 1330.73 | 666.37 | 666.47 |
| 392 | Ac-F$r8AYWEFL$A-NH$_2$ | 1110 | 1378.73 | 690.37 | 690.44 |
| 393 | Ac-F$r8AYWEWL$A-NH$_2$ | 1111 | 1417.74 | 709.87 | 709.91 |
| 394 | Ac-F$r8AYWERL$A-NH$_2$ | 1112 | 1387.77 | 694.89 | 1388.66 |
| 395 | Ac-F$r8AYWEKL$A-NH$_2$ | 1113 | 1359.76 | 680.88 | 1361.21 |
| 396 | Ac-F$r8AYWEAc3cL$V-NH$_2$ | 1114 | 1342.73 | 672.37 | 1343.59 |
| 397 | Ac-F$r8AYWEAc3cL$F-NH$_2$ | 1115 | 1390.73 | 696.37 | 1392.58 |
| 398 | Ac-F$r8AYWEAc3cL$W-NH$_2$ | 1116 | 1429.74 | 715.87 | 1431.29 |
| 399 | Ac-F$r8AYWEAc3cL$R-NH$_2$ | 1117 | 1399.77 | 700.89 | 700.95 |
| 400 | Ac-F$r8AYWEAc3cL$K-NH$_2$ | 1118 | 1371.76 | 686.88 | 686.97 |
| 401 | Ac-F$r8AYWEAc3cL$AV-NH$_2$ | 1119 | 1413.77 | 707.89 | 707.91 |
| 402 | Ac-F$r8AYWEAc3cL$AF-NH$_2$ | 1120 | 1461.77 | 731.89 | 731.96 |
| 403 | Ac-F$r8AYWEAc3cL$AW-NH$_2$ | 1121 | 1500.78 | 751.39 | 751.5 |
| 404 | Ac-F$r8AYWEAc3cL$AR-NH$_2$ | 1122 | 1470.80 | 736.40 | 736.47 |
| 405 | Ac-F$r8AYWEAc3cL$AK-NH$_2$ | 1123 | 1442.80 | 722.40 | 722.41 |
| 406 | Ac-F$r8AYWEAc3cL$AH-NH$_2$ | 1124 | 1451.76 | 726.88 | 726.93 |
| 407 | Ac-LTF2NO2$r8HYWAQL$S-NH$_2$ | 1125 | 1642.85 | 822.43 | 822.54 |

TABLE 2b-continued

| SP | Sequence | SEQ ID NO: | Exact mass | M + 2 | Observed mass (m/e) |
|---|---|---|---|---|---|
| 408 | Ac-LTA$r8HYAAQL$S-NH$_2$ | 1126 | 1406.79 | 704.40 | 704.5 |
| 409 | Ac-LTF$r8HYAAQL$S-NH$_2$ | 1127 | 1482.82 | 742.41 | 742.47 |
| 410 | Ac-QSQQTF$r8NLWALL$AN-NH$_2$ | 1128 | 1966.07 | 984.04 | 984.38 |
| 411 | Ac-QAibQQTF$r8NLWALL$AN-NH$_2$ | 1129 | 1964.09 | 983.05 | 983.42 |
| 412 | Ac-QAibQQTF$r8ALWALL$AN-NH$_2$ | 1130 | 1921.08 | 961.54 | 961.59 |
| 413 | Ac-AAAATF$r8AAWAAL$AA-NH$_2$ | 1131 | 1608.90 | 805.45 | 805.52 |
| 414 | Ac-F$r8AAWRAL$Q-NH$_2$ | 1132 | 1294.76 | 648.38 | 648.48 |
| 415 | Ac-TF$r8AAWAAL$Q-NH$_2$ | 1133 | 1310.74 | 656.37 | 1311.62 |
| 416 | Ac-TF$r8AAWRAL$A-NH$_2$ | 1134 | 1338.78 | 670.39 | 670.46 |
| 417 | Ac-VF$r8AAWRAL$Q-NH$_2$ | 1135 | 1393.82 | 697.91 | 697.99 |
| 418 | Ac-AF$r8AAWAAL$A-NH$_2$ | 1136 | 1223.71 | 612.86 | 1224.67 |
| 420 | Ac-TF$r8AAWKAL$Q-NH$_2$ | 1137 | 1367.80 | 684.90 | 684.97 |
| 421 | Ac-TF$r8AAWOAL$Q-NH$_2$ | 1138 | 1353.78 | 677.89 | 678.01 |
| 422 | Ac-TF$r8AAWSAL$Q-NH$_2$ | 1139 | 1326.73 | 664.37 | 664.47 |
| 423 | Ac-LTF$r8AAWRAL$Q-NH$_2$ | 1140 | 1508.89 | 755.45 | 755.49 |
| 424 | Ac-F$r8AYWAQL$A-NH$_2$ | 1141 | 1301.72 | 651.86 | 651.96 |
| 425 | Ac-F$r8AWWAAL$A-NH$_2$ | 1142 | 1267.71 | 634.86 | 634.87 |
| 426 | Ac-F$r8AWWAQL$A-NH$_2$ | 1143 | 1324.73 | 663.37 | 663.43 |
| 427 | Ac-F$r8AYWEAL$-NH$_2$ | 1144 | 1231.66 | 616.83 | 1232.93 |
| 428 | Ac-F$r8AYWAAL$-NH$_2$ | 1145 | 1173.66 | 587.83 | 1175.09 |
| 429 | Ac-F$r8AYWKAL$-NH$_2$ | 1146 | 1230.72 | 616.36 | 616.44 |
| 430 | Ac-F$r8AYWOAL$-NH$_2$ | 1147 | 1216.70 | 609.35 | 609.48 |
| 431 | Ac-F$r8AYWQAL$-NH$_2$ | 1148 | 1230.68 | 616.34 | 616.44 |
| 432 | Ac-F$r8AYWAQL$-NH$_2$ | 1149 | 1230.68 | 616.34 | 616.37 |
| 433 | Ac-F$r8HYWDQL$S-NH$_2$ | 1150 | 1427.72 | 714.86 | 714.86 |
| 434 | Ac-F$r8HFWEQL$S-NH$_2$ | 1151 | 1425.74 | 713.87 | 713.98 |
| 435 | Ac-F$r8AYWHQL$S-NH$_2$ | 1152 | 1383.73 | 692.87 | 692.96 |
| 436 | Ac-F$r8AYWKQL$S-NH$_2$ | 1153 | 1374.77 | 688.39 | 688.45 |
| 437 | Ac-F$r8AYWOQL$S-NH$_2$ | 1154 | 1360.75 | 681.38 | 681.49 |
| 438 | Ac-F$r8HYWSQL$S-NH$_2$ | 1155 | 1399.73 | 700.87 | 700.95 |
| 439 | Ac-F$r8HWWEQL$S-NH$_2$ | 1156 | 1464.76 | 733.38 | 733.44 |
| 440 | Ac-F$r8HWWAQL$S-NH$_2$ | 1157 | 1406.75 | 704.38 | 704.43 |
| 441 | Ac-F$r8AWWHQL$S-NH$_2$ | 1158 | 1406.75 | 704.38 | 704.43 |
| 442 | Ac-F$r8AWWKQL$S-NH$_2$ | 1159 | 1397.79 | 699.90 | 699.92 |
| 443 | Ac-F$r8AWWOQL$S-NH$_2$ | 1160 | 1383.77 | 692.89 | 692.96 |
| 444 | Ac-F$r8HWWSQL$S-NH$_2$ | 1161 | 1422.75 | 712.38 | 712.42 |
| 445 | Ac-LTF$r8NYWAN1eL$Q-NH$_2$ | 1162 | 1600.90 | 801.45 | 801.52 |
| 446 | Ac-LTF$r8NLWAQL$Q-NH$_2$ | 1163 | 1565.90 | 783.95 | 784.06 |

TABLE 2b-continued

| SP | Sequence | SEQ ID NO: | Exact mass | M + 2 | Observed mass (m/e) |
|---|---|---|---|---|---|
| 447 | Ac-LTF$r8NYWANleL$A-NH₂ | 1164 | 1543.88 | 772.94 | 773.03 |
| 448 | Ac-LTF$r8NLWAQL$A-NH₂ | 1165 | 1508.88 | 755.44 | 755.49 |
| 449 | Ac-LTF$r8AYWANleL$Q-NH₂ | 1166 | 1557.90 | 779.95 | 780.06 |
| 450 | Ac-LTF$r8ALWAQL$Q-NH₂ | 1167 | 1522.89 | 762.45 | 762.45 |
| 451 | Ac-LAF$r8NYWANleL$Q-NH₂ | 1168 | 1570.89 | 786.45 | 786.5 |
| 452 | Ac-LAF$r8NLWAQL$Q-NH₂ | 1169 | 1535.89 | 768.95 | 769.03 |
| 453 | Ac-LAF$r8AYWANleL$A-NH₂ | 1170 | 1470.86 | 736.43 | 736.47 |
| 454 | Ac-LAF$r8ALWAQL$A-NH₂ | 1171 | 1435.86 | 718.93 | 719.01 |
| 455 | Ac-LAF$r8AYWAAL$A-NH₂ | 1172 | 1428.82 | 715.41 | 715.41 |
| 456 | Ac-F$r8AYWEAc3cL$AAib-NH₂ | 1173 | 1399.75 | 700.88 | 700.95 |
| 457 | Ac-F$r8AYWAQL$AA-NH₂ | 1174 | 1372.75 | 687.38 | 687.78 |
| 458 | Ac-F$r8AYWAAc3cL$AA-NH₂ | 1175 | 1327.73 | 664.87 | 664.84 |
| 459 | Ac-F$r8AYWSAc3cL$AA-NH₂ | 1176 | 1343.73 | 672.87 | 672.9 |
| 460 | Ac-F$r8AYWEAc3cL$AS-NH₂ | 1177 | 1401.73 | 701.87 | 701.84 |
| 461 | Ac-F$r8AYWEAc3cL$AT-NH₂ | 1178 | 1415.75 | 708.88 | 708.87 |
| 462 | Ac-F$r8AYWEAc3cL$AL-NH₂ | 1179 | 1427.79 | 714.90 | 714.94 |
| 463 | Ac-F$r8AYWEAc3cL$AQ-NH₂ | 1180 | 1442.76 | 722.38 | 722.41 |
| 464 | Ac-F$r8AFWEAc3cL$AA-NH₂ | 1181 | 1369.74 | 685.87 | 685.93 |
| 465 | Ac-F$r8AWWEAc3cL$AA-NH₂ | 1182 | 1408.75 | 705.38 | 705.39 |
| 466 | Ac-F$r8AYWEAc3cL$SA-NH₂ | 1183 | 1401.73 | 701.87 | 701.99 |
| 467 | Ac-F$r8AYWEAL$AA-NH₂ | 1184 | 1373.74 | 687.87 | 687.93 |
| 468 | Ac-F$r8AYWENleL$AA-NH₂ | 1185 | 1415.79 | 708.90 | 708.94 |
| 469 | Ac-F$r8AYWEAc3cL$AbuA-NH₂ | 1186 | 1399.75 | 700.88 | 700.95 |
| 470 | Ac-F$r8AYWEAc3cL$NleA-NH₂ | 1187 | 1427.79 | 714.90 | 714.86 |
| 471 | Ac-F$r8AYWEAibL$NleA-NH₂ | 1188 | 1429.80 | 715.90 | 715.97 |
| 472 | Ac-F$r8AYWEAL$NleA-NH₂ | 1189 | 1415.79 | 708.90 | 708.94 |
| 473 | Ac-F$r8AYWENleL$NleA-NH₂ | 1190 | 1457.83 | 729.92 | 729.96 |
| 474 | Ac-F$r8AYWEAibL$Abu-NH₂ | 1191 | 1330.73 | 666.37 | 666.39 |
| 475 | Ac-F$r8AYWENleL$Abu-NH₂ | 1192 | 1358.76 | 680.38 | 680.39 |
| 476 | Ac-F$r8AYWEAL$Abu-NH₂ | 1193 | 1316.72 | 659.36 | 659.36 |
| 477 | Ac-LTF$r8AFWAQL$S-NH₂ | 1194 | 1515.85 | 758.93 | 759.12 |
| 478 | Ac-LTF$r8AWWAQL$S-NH₂ | 1195 | 1554.86 | 778.43 | 778.51 |
| 479 | Ac-LTF$r8AYWAQI$S-NH₂ | 1196 | 1531.84 | 766.92 | 766.96 |
| 480 | Ac-LTF$r8AYWAQNle$S-NH₂ | 1197 | 1531.84 | 766.92 | 766.96 |
| 481 | Ac-LTF$r8AYWAQL$SA-NH₂ | 1198 | 1602.88 | 802.44 | 802.48 |
| 482 | Ac-LTF$r8AWWAQL$A-NH₂ | 1199 | 1538.87 | 770.44 | 770.89 |
| 483 | Ac-LTF$r8AYWAQI$A-NH₂ | 1200 | 1515.85 | 758.93 | 759.42 |
| 484 | Ac-LTF$r8AYWAQNle$A-NH₂ | 1201 | 1515.85 | 758.93 | 759.42 |
| 485 | Ac-LTF$r8AYWAQL$AA-NH₂ | 1202 | 1586.89 | 794.45 | 794.94 |

TABLE 2b-continued

| SP | Sequence | SEQ ID NO: | Exact mass | M + 2 | Observed mass (m/e) |
|---|---|---|---|---|---|
| 486 | Ac-LTF$r8HWWAQL$S-NH$_2$ | 1203 | 1620.88 | 811.44 | 811.47 |
| 487 | Ac-LTF$r8HRWAQL$S-NH$_2$ | 1204 | 1590.90 | 796.45 | 796.52 |
| 488 | Ac-LTF$r8HKWAQL$S-NH$_2$ | 1205 | 1562.90 | 782.45 | 782.53 |
| 489 | Ac-LTF$r8HYWAQL$W-NH$_2$ | 1206 | 1696.91 | 849.46 | 849.5 |
| 491 | Ac-F$r8AYWAbuAL$A-NH$_2$ | 1207 | 1258.71 | 630.36 | 630.5 |
| 492 | Ac-F$r8AbuYWEAL$A-NH$_2$ | 1208 | 1316.72 | 659.36 | 659.51 |
| 493 | Ac-NlePRF%r8NYWRLL%QN-NH$_2$ | 1209 | 1954.13 | 978.07 | 978.54 |
| 494 | Ac-TSF%r8HYWAQL%S-NH$_2$ | 1210 | 1573.83 | 787.92 | 787.98 |
| 495 | Ac-LTF%r8AYWAQL%S-NH$_2$ | 1211 | 1533.86 | 767.93 | 768 |
| 496 | Ac-HTF$r8HYWAQL$S-NH$_2$ | 1212 | 1621.84 | 811.92 | 811.96 |
| 497 | Ac-LHF$r8HYWAQL$S-NH$_2$ | 1213 | 1633.88 | 817.94 | 818.02 |
| 498 | Ac-LTF$r8HHWAQL$S-NH$_2$ | 1214 | 1571.86 | 786.93 | 786.94 |
| 499 | Ac-LTF$r8HYWHQL$S-NH$_2$ | 1215 | 1663.89 | 832.95 | 832.38 |
| 500 | Ac-LTF$r8HYWAHL$S-NH$_2$ | 1216 | 1606.87 | 804.44 | 804.48 |
| 501 | Ac-LTF$r8HYWAQL$H-NH$_2$ | 1217 | 1647.89 | 824.95 | 824.98 |
| 502 | Ac-LTF$r8HYWAQL$S-NHPr | 1218 | 1639.91 | 820.96 | 820.98 |
| 503 | Ac-LTF$r8HYWAQL$S-NHsBu | 1219 | 1653.93 | 827.97 | 828.02 |
| 504 | Ac-LTF$r8HYWAQL$S-NHiBu | 1220 | 1653.93 | 827.97 | 828.02 |
| 505 | Ac-LTF$r8HYWAQL$S-NHBn | 1221 | 1687.91 | 844.96 | 844.44 |
| 506 | Ac-LTF$r8HYWAQL$S-NHPe | 1222 | 1700.92 | 851.46 | 851.99 |
| 507 | Ac-LTF$r8HYWAQL$S-NHChx | 1223 | 1679.94 | 840.97 | 841.04 |
| 508 | Ac-ETF$r8AYWAQL$S-NH$_2$ | 1224 | 1547.80 | 774.90 | 774.96 |
| 509 | Ac-STF$r8AYWAQL$S-NH$_2$ | 1225 | 1505.79 | 753.90 | 753.94 |
| 510 | Ac-LEF$r8AYWAQL$S-NH$_2$ | 1226 | 1559.84 | 780.92 | 781.25 |
| 511 | Ac-LSF$r8AYWAQL$S-NH$_2$ | 1227 | 1517.83 | 759.92 | 759.93 |
| 512 | Ac-LTF$r8EYWAQL$S-NH$_2$ | 1228 | 1589.85 | 795.93 | 795.97 |
| 513 | Ac-LTF$r8SYWAQL$S-NH$_2$ | 1229 | 1547.84 | 774.92 | 774.96 |
| 514 | Ac-LTF$r8AYWEQL$S-NH$_2$ | 1230 | 1589.85 | 795.93 | 795.9 |
| 515 | Ac-LTF$r8AYWAEL$S-NH$_2$ | 1231 | 1532.83 | 767.42 | 766.96 |
| 516 | Ac-LTF$r8AYWASL$S-NH$_2$ | 1232 | 1490.82 | 746.41 | 746.46 |
| 517 | Ac-LTF$r8AYWAQL$E-NH$_2$ | 1233 | 1573.85 | 787.93 | 787.98 |
| 518 | Ac-LTF2CN$r8HYWAQL$S-NH$_2$ | 1234 | 1622.86 | 812.43 | 812.47 |
| 519 | Ac-LTF3Cl$r8HYWAQL$S-NH$_2$ | 1235 | 1631.83 | 816.92 | 816.99 |
| 520 | Ac-LTDip$r8HYWAQL$S-NH$_2$ | 1236 | 1673.90 | 837.95 | 838.01 |
| 521 | Ac-LTF$r8HYWAQT1e$S-NH$_2$ | 1237 | 1597.87 | 799.94 | 800.04 |
| 522 | Ac-F$r8AY6clWEAL$A-NH$_2$ | 1238 | 1336.66 | 669.33 | 1338.56 |
| 523 | Ac-F$r8AYd16brWEAL$A-NH$_2$ | 1239 | 1380.61 | 691.31 | 692.2 |
| 524 | Ac-F$r8AYd16fWEAL$A-NH$_2$ | 1240 | 1320.69 | 661.35 | 1321.61 |

TABLE 2b-continued

| SP | Sequence | SEQ ID NO: | Exact mass | M + 2 | Observed mass (m/e) |
|---|---|---|---|---|---|
| 525 | Ac-F$r8AYdl4mWEAL$A-NH₂ | 1241 | 1316.72 | 659.36 | 659.36 |
| 526 | Ac-F$r8AYdl5clWEAL$A-NH₂ | 1242 | 1336.66 | 669.33 | 669.35 |
| 527 | Ac-F$r8AYdl7mWEAL$A-NH₂ | 1243 | 1316.72 | 659.36 | 659.36 |
| 528 | Ac-LTF%r8HYWAQL%A-NH₂ | 1244 | 1583.89 | 792.95 | 793.01 |
| 529 | Ac-LTF$r8HCouWAQL$S-NH₂ | 1245 | 1679.87 | 840.94 | 841.38 |
| 530 | Ac-LTFEHC0uWAQLTS-NH₂ | 1246 | 1617.75 | 809.88 | 809.96 |
| 531 | Ac-LTA$r8HCouWAQL$S-NH₂ | 1247 | 1603.84 | 802.92 | 803.36 |
| 532 | Ac-F$r8AYWEAL$AbuA-NH₂ | 1248 | 1387.75 | 694.88 | 694.88 |
| 533 | Ac-F$r8AYWEAI$AA-NH₂ | 1249 | 1373.74 | 687.87 | 687.93 |
| 534 | Ac-F$r8AYWEANle$AA-NH₂ | 1250 | 1373.74 | 687.87 | 687.93 |
| 535 | Ac-F$r8AYWEAm1L$AA-NH₂ | 1251 | 1429.80 | 715.90 | 715.97 |
| 536 | Ac-F$r8AYWQAL$AA-NH₂ | 1252 | 1372.75 | 687.38 | 687.48 |
| 537 | Ac-F$r8AYWAAL$AA-NH₂ | 1253 | 1315.73 | 658.87 | 658.92 |
| 538 | Ac-F$r8AYWAbuAL$AA-NH₂ | 1254 | 1329.75 | 665.88 | 665.95 |
| 539 | Ac-F$r8AYWNleAL$AA-NH₂ | 1255 | 1357.78 | 679.89 | 679.94 |
| 540 | Ac-F$r8AbuYWEAL$AA-NH₂ | 1256 | 1387.75 | 694.88 | 694.96 |
| 541 | Ac-F$r8NleYWEAL$AA-NH₂ | 1257 | 1415.79 | 708.90 | 708.94 |
| 542 | Ac-F$r8FYWEAL$AA-NH₂ | 1258 | 1449.77 | 725.89 | 725.97 |
| 543 | Ac-LTF$r8HYWAQhL$S-NH₂ | 1259 | 1611.88 | 806.94 | 807 |
| 544 | Ac-LTF$r8HYWAQAdm$S-NH₂ | 1260 | 1675.91 | 838.96 | 839.04 |
| 545 | Ac-LTF$r8HYWAQIg1$S-NH₂ | 1261 | 1659.88 | 830.94 | 829.94 |
| 546 | Ac-F$r8AYWAQL$AA-NH₂ | 1262 | 1372.75 | 687.38 | 687.48 |
| 547 | Ac-LTF$r8ALWAQL$Q-NH₂ | 1263 | 1522.89 | 762.45 | 762.52 |
| 548 | Ac-F$r8AYWEAL$AA-NH₂ | 1264 | 1373.74 | 687.87 | 687.93 |
| 549 | Ac-F$r8AYWENleL$AA-NH₂ | 1265 | 1415.79 | 708.90 | 708.94 |
| 550 | Ac-F$r8AYWEAibL$Abu-NH₂ | 1266 | 1330.73 | 666.37 | 666.39 |
| 551 | Ac-F$r8AYWENleL$Abu-NH₂ | 1267 | 1358.76 | 680.38 | 680.38 |
| 552 | Ac-F$r8AYWEAL$Abu-NH₂ | 1268 | 1316.72 | 659.36 | 659.36 |
| 553 | Ac-F$r8AYWEAc3cL$AbuA-NH₂ | 1269 | 1399.75 | 700.88 | 700.95 |
| 554 | Ac-F$r8AYWEAc3cL$NleA-NH₂ | 1270 | 1427.79 | 714.90 | 715.01 |
| 555 | H-LTF$r8AYWAQL$S-NH₂ | 1271 | 1489.83 | 745.92 | 745.95 |
| 556 | mdPEG3-LTF$r8AYWAQL$S-NH₂ | 1272 | 1679.92 | 840.96 | 840.97 |
| 557 | mdPEG7-LTF$r8AYWAQL$S-NH₂ | 1273 | 1856.02 | 929.01 | 929.03 |
| 558 | Ac-F$r8ApmpEt6clWEAL$A-NH₂ | 1274 | 1470.71 | 736.36 | 788.17 |
| 559 | Ac-LTF3Cl$r8AYWAQL$S-NH₂ | 1275 | 1565.81 | 783.91 | 809.18 |
| 560 | Ac-LTF3Cl$r8HYWAQL$A-NH₂ | 1276 | 1615.83 | 808.92 | 875.24 |
| 561 | Ac-LTF3Cl$r8HYWWQL$S-NH₂ | 1277 | 1746.87 | 874.44 | 841.65 |
| 562 | Ac-LTF3Cl$r8AYWWQL$S-NH₂ | 1278 | 1680.85 | 841.43 | 824.63 |
| 563 | Ac-LTF$r8AYWWQL$S-NH₂ | 1279 | 1646.89 | 824.45 | 849.98 |

TABLE 2b-continued

| SP | Sequence | SEQ ID NO: | Exact mass | M + 2 | Observed mass (m/e) |
|---|---|---|---|---|---|
| 564 | Ac-LTF$r8HYWWQL$A-NH$_2$ | 1280 | 1696.91 | 849.46 | 816.67 |
| 565 | Ac-LTF$r8AYWWQL$A-NH$_2$ | 1281 | 1630.89 | 816.45 | 776.15 |
| 566 | Ac-LTF4F$r8AYWAQL$S-NH$_2$ | 1282 | 1549.83 | 775.92 | 776.15 |
| 567 | Ac-LTF2F$r8AYWAQL$S-NH$_2$ | 1283 | 1549.83 | 775.92 | 776.15 |
| 568 | Ac-LTF3F$r8AYWAQL$S-NH$_2$ | 1284 | 1549.83 | 775.92 | 785.12 |
| 569 | Ac-LTF34F2$r8AYWAQL$S-NH$_2$ | 1285 | 1567.83 | 784.92 | 785.12 |
| 570 | Ac-LTF35F2$r8AYWAQL$S-NH$_2$ | 1286 | 1567.83 | 784.92 | 1338.74 |
| 571 | Ac-F3Cl$r8AYWEAL$A-NH$_2$ | 1287 | 1336.66 | 669.33 | 705.28 |
| 572 | Ac-F3Cl$r8AYWEAL$AA-NH$_2$ | 1288 | 1407.70 | 704.85 | 680.11 |
| 573 | Ac-F$r8AY6clWEAL$AA-NH$_2$ | 1289 | 1407.70 | 704.85 | 736.83 |
| 574 | Ac-F$r8AY6clWEAL$-NH$_2$ | 1290 | 1265.63 | 633.82 | 784.1 |
| 575 | Ac-LTF$r8HYWAQLSt/S-NH$_2$ | 1291 | 16.03 | 9.02 | 826.98 |
| 576 | Ac-LTF$r8HYWAQL$S-NHsBu | 1292 | 1653.93 | 827.97 | 828.02 |
| 577 | Ac-STF$r8AYWAQL$S-NH$_2$ | 1293 | 1505.79 | 753.90 | 753.94 |
| 578 | Ac-LTF$r8AYWAEL$S-NH$_2$ | 1294 | 1532.83 | 767.42 | 767.41 |
| 579 | Ac-LTF$r8AYWAQL$E-NH$_2$ | 1295 | 1573.85 | 787.93 | 787.98 |
| 580 | mdPEG3-LTF$r8AYWAQL$S-NH$_2$ | 1296 | 1679.92 | 840.96 | 840.97 |
| 581 | Ac-LTF$r8AYWAQhL$S-NH$_2$ | 1297 | 1545.86 | 773.93 | 774.31 |
| 583 | Ac-LTF$r8AYWAQCha$S-NH$_2$ | 1298 | 1571.88 | 786.94 | 787.3 |
| 584 | Ac-LTF$r8AYWAQChg$S-NH$_2$ | 1299 | 1557.86 | 779.93 | 780.4 |
| 585 | Ac-LTF$r8AYWAQCba$S-NH$_2$ | 1300 | 1543.84 | 772.92 | 780.13 |
| 586 | Ac-LTF$r8AYWAQF$S-NH$_2$ | 1301 | 1565.83 | 783.92 | 784.2 |
| 587 | Ac-LTF4F$r8HYWAQhL$S-NH$_2$ | 1302 | 1629.87 | 815.94 | 815.36 |
| 588 | Ac-LTF4F$r8HYWAQCha$S-NH$_2$ | 1303 | 1655.89 | 828.95 | 828.39 |
| 589 | Ac-LTF4F$r8HYWAQChg$S-NH$_2$ | 1304 | 1641.87 | 821.94 | 821.35 |
| 590 | Ac-LTF4F$r8HYWAQCba$S-NH$_2$ | 1305 | 1627.86 | 814.93 | 814.32 |
| 591 | Ac-LTF4F$r8AYWAQhL$S-NH$_2$ | 1306 | 1563.85 | 782.93 | 782.36 |
| 592 | Ac-LTF4F$r8AYWAQCha$S-NH$_2$ | 1307 | 1589.87 | 795.94 | 795.38 |
| 593 | Ac-LTF4F$r8AYWAQChg$S-NH$_2$ | 1308 | 1575.85 | 788.93 | 788.35 |
| 594 | Ac-LTF4F$r8AYWAQCba$S-NH$_2$ | 1309 | 1561.83 | 781.92 | 781.39 |
| 595 | Ac-LTF3Cl$r8AYWAQhL$S-NH$_2$ | 1310 | 1579.82 | 790.91 | 790.35 |
| 596 | Ac-LTF3Cl$r8AYWAQCha$S-NH$_2$ | 1311 | 1605.84 | 803.92 | 803.67 |
| 597 | Ac-LTF3Cl$r8AYWAQChg$S-NH$_2$ | 1312 | 1591.82 | 796.91 | 796.34 |
| 598 | Ac-LTF3Cl$r8AYWAQCba$S-NH$_2$ | 1313 | 1577.81 | 789.91 | 789.39 |
| 599 | Ac-LTF$r8AYWAQhF$S-NH$_2$ | 1314 | 1579.84 | 790.92 | 791.14 |
| 600 | Ac-LTF$r8AYWAQF3CF3$S-NH$_2$ | 1315 | 1633.82 | 817.91 | 818.15 |
| 601 | Ac-LTF$r8AYWAQF3Me$S-NH$_2$ | 1316 | 1581.86 | 791.93 | 791.32 |
| 602 | Ac-LTF$r8AYWAQ1Nal$S-NH$_2$ | 1317 | 1615.84 | 808.92 | 809.18 |

TABLE 2b-continued

| SP | Sequence | SEQ ID NO: | Exact mass | M + 2 | Observed mass (m/e) |
|---|---|---|---|---|---|
| 603 | Ac-LTF$r8AYWAQBip$S-NH$_2$ | 1318 | 1641.86 | 821.93 | 822.13 |
| 604 | Ac-LTF$r8FYWAQL$A-NH$_2$ | 1319 | 1591.88 | 796.94 | 797.33 |
| 605 | Ac-LTF$r8HYWAQL$S-NHAm | 1320 | 1667.94 | 834.97 | 835.92 |
| 606 | Ac-LTF$r8HYWAQL$S-NHiAm | 1321 | 1667.94 | 834.97 | 835.55 |
| 607 | Ac-LTF$r8HYWAQL$S-NHnPr3Ph | 1322 | 1715.94 | 858.97 | 859.79 |
| 608 | Ac-LTF$r8HYWAQL$S-NHnBu3,3Me | 1323 | 1681.96 | 841.98 | 842.49 |
| 610 | Ac-LTF$r8HYWAQL$S-NHnPr | 1324 | 1639.91 | 820.96 | 821.58 |
| 611 | Ac-LTF$r8HYWAQL$S-NHnEt2Ch | 1325 | 1707.98 | 854.99 | 855.35 |
| 612 | Ac-LTF$r8HYWAQL$S-NHHex | 1326 | 1681.96 | 841.98 | 842.4 |
| 613 | Ac-LTF$r8AYWAQL$S-NHmdPeg2 | 1327 | 1633.91 | 817.96 | 818.35 |
| 614 | Ac-LTF$r8AYWAQL$A-NHmdPeg2 | 1328 | 1617.92 | 809.96 | 810.3 |
| 615 | Ac-LTF$r8AYWAQL$A-NHmdPeg4 | 1329 | 1705.97 | 853.99 | 854.33 |
| 616 | Ac-F$r8AYdl4mWEAL$A-NH$_2$ | 1330 | 1316.72 | 659.36 | 659.44 |
| 617 | Ac-F$r8AYdl5clWEAL$A-NH$_2$ | 1331 | 1336.66 | 669.33 | 669.43 |
| 618 | Ac-LThF$r8AYWAQL$S-NH$_2$ | 1332 | 1545.86 | 773.93 | 774.11 |
| 619 | Ac-LT2Nal$r8AYWAQL$S-NH$_2$ | 1333 | 1581.86 | 791.93 | 792.43 |
| 620 | Ac-LTA$r8AYWAQL$S-NH$_2$ | 1334 | 1455.81 | 728.91 | 729.15 |
| 621 | Ac-LTF$r8AYWVQL$S-NH$_2$ | 1335 | 1559.88 | 780.94 | 781.24 |
| 622 | Ac-LTF$r8HYWAAL$A-NH$_2$ | 1336 | 1524.85 | 763.43 | 763.86 |
| 623 | Ac-LTF$r8VYWAQL$A-NH$_2$ | 1337 | 1543.88 | 772.94 | 773.37 |
| 624 | Ac-LTF$r8IYWAQL$S-NH$_2$ | 1338 | 1573.89 | 787.95 | 788.17 |
| 625 | Ac-FTF$r8VYWSQL$S-NH$_2$ | 1339 | 1609.85 | 805.93 | 806.22 |
| 626 | Ac-ITF$r8FYWAQL$S-NH$_2$ | 1340 | 1607.88 | 804.94 | 805.2 |
| 627 | Ac-2NalTF$r8VYWSQL$S-NH$_2$ | 1341 | 1659.87 | 830.94 | 831.2 |
| 628 | Ac-ITF$r8LYWSQL$S-NH$_2$ | 1342 | 1589.89 | 795.95 | 796.13 |
| 629 | Ac-FTF$r8FYWAQL$S-NH$_2$ | 1343 | 1641.86 | 821.93 | 822.13 |
| 630 | Ac-WTF$r8VYWAQL$S-NH$_2$ | 1344 | 1632.87 | 817.44 | 817.69 |
| 631 | Ac-WTF$r8WYWAQL$S-NH$_2$ | 1345 | 1719.88 | 860.94 | 861.36 |
| 632 | Ac-VTF$r8AYWSQL$S-NH$_2$ | 1346 | 1533.82 | 767.91 | 768.19 |
| 633 | Ac-WTF$r8FYWSQL$S-NH$_2$ | 1347 | 1696.87 | 849.44 | 849.7 |
| 634 | Ac-FTF$r8IYWAQL$S-NH$_2$ | 1348 | 1607.88 | 804.94 | 805.2 |
| 635 | Ac-WTF$r8VYWSQL$S-NH$_2$ | 1349 | 1648.87 | 825.44 | 824.8 |
| 636 | Ac-FTF$r8LYWSQL$S-NH$_2$ | 1350 | 1623.87 | 812.94 | 812.8 |
| 637 | Ac-YTF$r8FYWSQL$S-NH$_2$ | 1351 | 1673.85 | 837.93 | 837.8 |
| 638 | Ac-LTF$r8AY6clWEAL$A-NH$_2$ | 1352 | 1550.79 | 776.40 | 776.14 |
| 639 | Ac-LTF$r8AY6clWSQL$S-NH$_2$ | 1353 | 1581.80 | 791.90 | 791.68 |
| 640 | Ac-F$r8AY6clWSAL$A-NH$_2$ | 1354 | 1294.65 | 648.33 | 647.67 |
| 641 | Ac-F$r8AY6clWQAL$AA-NH$_2$ | 1355 | 1406.72 | 704.36 | 703.84 |
| 642 | Ac-LHF$r8AYWAQL$S-NH$_2$ | 1356 | 1567.86 | 784.93 | 785.21 |

TABLE 2b-continued

| SP | Sequence | SEQ ID NO: | Exact mass | M + 2 | Observed mass (m/e) |
|---|---|---|---|---|---|
| 643 | Ac-LTF$r8AYWAQL$S-NH$_2$ | 1357 | 1531.84 | 766.92 | 767.17 |
| 644 | Ac-LTF$r8AHWAQL$S-NH$_2$ | 1358 | 1505.84 | 753.92 | 754.13 |
| 645 | Ac-LTF$r8AYWAHL$S-NH$_2$ | 1359 | 1540.84 | 771.42 | 771.61 |
| 646 | Ac-LTF$r8AYWAQL$H-NH$_2$ | 1360 | 1581.87 | 791.94 | 792.15 |
| 647 | H-LTF$r8AYWAQL$A-NH$_2$ | 1361 | 1473.84 | 737.92 | 737.29 |
| 648 | Ac-HHF$r8AYWAQL$S-NH$_2$ | 1362 | 1591.83 | 796.92 | 797.35 |
| 649 | Ac-aAibWTF$r8VYWSQL$S-NH$_2$ | 1363 | 1804.96 | 903.48 | 903.64 |
| 650 | Ac-AibWTF$r8HYWAQL$S-NH$_2$ | 1364 | 1755.91 | 878.96 | 879.4 |
| 651 | Ac-AibAWTF$r8HYWAQL$S-NH$_2$ | 1365 | 1826.95 | 914.48 | 914.7 |
| 652 | Ac-fWTF$r8HYWAQL$S-NH$_2$ | 1366 | 1817.93 | 909.97 | 910.1 |
| 653 | Ac-AibWWTF$r8HYWAQL$S-NH$_2$ | 1367 | 1941.99 | 972.00 | 972.2 |
| 654 | Ac-WTF$r8LYWSQL$S-NH$_2$ | 1368 | 1662.88 | 832.44 | 832.8 |
| 655 | Ac-WTF$r8NleYWSQL$S-NH$_2$ | 1369 | 1662.88 | 832.44 | 832.6 |
| 656 | Ac-LTF$r8AYWSQL$a-NH$_2$ | 1370 | 1531.84 | 766.92 | 767.2 |
| 657 | Ac-LTF$r8EYWARL$A-NH$_2$ | 1371 | 1601.90 | 801.95 | 802.1 |
| 658 | Ac-LTF$r8EYWAHL$A-NH$_2$ | 1372 | 1582.86 | 792.43 | 792.6 |
| 659 | Ac-aTF$r8AYWAQL$S-NH$_2$ | 1373 | 1489.80 | 745.90 | 746.08 |
| 660 | Ac-AibTF$r8AYWAQL$S-NH$_2$ | 1374 | 1503.81 | 752.91 | 753.11 |
| 661 | Ac-AmfTF$r8AYWAQL$S-NH$_2$ | 1375 | 1579.84 | 790.92 | 791.14 |
| 662 | Ac-AmwTF$r8AYWAQL$S-NH$_2$ | 1376 | 1618.86 | 810.43 | 810.66 |
| 663 | Ac-NmLTF$r8AYWAQL$S-NH$_2$ | 1377 | 1545.86 | 773.93 | 774.11 |
| 664 | Ac-LNmTF$r8AYWAQL$S-NH$_2$ | 1378 | 1545.86 | 773.93 | 774.11 |
| 665 | Ac-LSarF$r8AYWAQL$S-NH$_2$ | 1379 | 1501.83 | 751.92 | 752.18 |
| 667 | Ac-LGF$r8AYWAQL$S-NH$_2$ | 1380 | 1487.82 | 744.91 | 745.15 |
| 668 | Ac-LTNmF$r8AYWAQL$S-NH$_2$ | 1381 | 1545.86 | 773.93 | 774.2 |
| 669 | Ac-TF$r8AYWAQL$S-NH$_2$ | 1382 | 1418.76 | 710.38 | 710.64 |
| 670 | Ac-ETF$r8AYWAQL$A-NH$_2$ | 1383 | 1531.81 | 766.91 | 767.2 |
| 671 | Ac-LTF$r8EYWAQL$A-NH$_2$ | 1384 | 1573.85 | 787.93 | 788.1 |
| 672 | Ac-LT2Nal$r8AYWSQL$S-NH$_2$ | 1385 | 1597.85 | 799.93 | 800.4 |
| 673 | Ac-LTF$r8AYWAAL$S-NH$_2$ | 1386 | 1474.82 | 738.41 | 738.68 |
| 674 | Ac-LTF$r8AYWAQhCha$S-NH$_2$ | 1387 | 1585.89 | 793.95 | 794.19 |
| 675 | Ac-LTF$r8AYWAQChg$S-NH$_2$ | 1388 | 1557.86 | 779.93 | 780.97 |
| 676 | Ac-LTF$r8AYWAQCba$S-NH$_2$ | 1389 | 1543.84 | 772.92 | 773.19 |
| 677 | Ac-LTF$r8AYWAQF3CF3$S-NH$_2$ | 1390 | 1633.82 | 817.91 | 818.15 |
| 678 | Ac-LTF$r8AYWAQ1Nal$S-NH$_2$ | 1391 | 1615.84 | 808.92 | 809.18 |
| 679 | Ac-LTF$r8AYWAQBip$S-NH$_2$ | 1392 | 1641.86 | 821.93 | 822.32 |
| 680 | Ac-LT2Nal$r8AYWAQL$S-NH$_2$ | 1393 | 1581.86 | 791.93 | 792.15 |
| 681 | Ac-LTF$r8AYWVQL$S-NH$_2$ | 1394 | 1559.88 | 780.94 | 781.62 |

TABLE 2b-continued

| SP | Sequence | SEQ ID NO: | Exact mass | M + 2 | Observed mass (m/e) |
|---|---|---|---|---|---|
| 682 | Ac-LTF$r8AWWAQL$S-NH$_2$ | 1395 | 1554.86 | 778.43 | 778.65 |
| 683 | Ac-FTF$r8VYWSQL$S-NH$_2$ | 1396 | 1609.85 | 805.93 | 806.12 |
| 684 | Ac-ITF$r8FYWAQL$S-NH$_2$ | 1397 | 1607.88 | 804.94 | 805.2 |
| 685 | Ac-ITF$r8LYWSQL$S-NH$_2$ | 1398 | 1589.89 | 795.95 | 796.22 |
| 686 | Ac-FTF$r8FYWAQL$S-NH$_2$ | 1399 | 1641.86 | 821.93 | 822.41 |
| 687 | Ac-VTF$r8AYWSQL$S-NH$_2$ | 1400 | 1533.82 | 767.91 | 768.19 |
| 688 | Ac-LTF$r8AHWAQL$S-NH$_2$ | 1401 | 1505.84 | 753.92 | 754.31 |
| 689 | Ac-LTF$r8AYWAQL$H-NH$_2$ | 1402 | 1581.87 | 791.94 | 791.94 |
| 690 | Ac-LTF$r8AYWAHL$S-NH$_2$ | 1403 | 1540.84 | 771.42 | 771.61 |
| 691 | Ac-aAibWTF$r8VYWSQL$S-NH$_2$ | 1404 | 1804.96 | 903.48 | 903.9 |
| 692 | Ac-AibWTF$r8HYWAQL$S-NH$_2$ | 1405 | 1755.91 | 878.96 | 879.5 |
| 693 | Ac-AibAWTF$r8HYWAQL$S-NH$_2$ | 1406 | 1826.95 | 914.48 | 914.7 |
| 694 | Ac-fWTF$r8HYWAQL$S-NH$_2$ | 1407 | 1817.93 | 909.97 | 910.2 |
| 695 | Ac-AibWWTF$r8HYWAQL$S-NH$_2$ | 1408 | 1941.99 | 972.00 | 972.7 |
| 696 | Ac-WTF$r8LYWSQL$S-NH$_2$ | 1409 | 1662.88 | 832.44 | 832.7 |
| 697 | Ac-WTF$r8NleYWSQL$S-NH$_2$ | 1410 | 1662.88 | 832.44 | 832.7 |
| 698 | Ac-LTF$r8AYWSQL$a-NH$_2$ | 1411 | 1531.84 | 766.92 | 767.2 |
| 699 | Ac-LTF$r8EYWARL$A-NH$_2$ | 1412 | 1601.90 | 801.95 | 802.2 |
| 700 | Ac-LTF$r8EYWAHL$A-NH$_2$ | 1413 | 1582.86 | 792.43 | 792.6 |
| 701 | Ac-aTF$r8AYWAQL$S-NH$_2$ | 1414 | 1489.80 | 745.90 | 746.1 |
| 702 | Ac-AibTF$r8AYWAQL$S-NH$_2$ | 1415 | 1503.81 | 752.91 | 753.2 |
| 703 | Ac-AmfTF$r8AYWAQL$S-NH$_2$ | 1416 | 1579.84 | 790.92 | 791.2 |
| 704 | Ac-AmwTF$r8AYWAQL$S-NH$_2$ | 1417 | 1618.86 | 810.43 | 810.7 |
| 705 | Ac-NmLTF$r8AYWAQL$S-NH$_2$ | 1418 | 1545.86 | 773.93 | 774.1 |
| 706 | Ac-LNmTF$r8AYWAQL$S-NH$_2$ | 1419 | 1545.86 | 773.93 | 774.4 |
| 707 | Ac-LSarF$r8AYWAQL$S-NH$_2$ | 1420 | 1501.83 | 751.92 | 752.1 |
| 708 | Ac-TF$r8AYWAQL$S-NH$_2$ | 1421 | 1418.76 | 710.38 | 710.8 |
| 709 | Ac-ETF$r8AYWAQL$A-NH$_2$ | 1422 | 1531.81 | 766.91 | 767.4 |
| 710 | Ac-LTF$r8EYWAQL$A-NH$_2$ | 1423 | 1573.85 | 787.93 | 788.2 |
| 711 | Ac-WTF$r8VYWSQL$S-NH$_2$ | 1424 | 1648.87 | 825.44 | 825.2 |
| 713 | Ac-YTF$r8FYWSQL$S-NH$_2$ | 1425 | 1673.85 | 837.93 | 837.3 |
| 714 | Ac-F$r8AY6clWSAL$A-NH$_2$ | 1426 | 1294.65 | 648.33 | 647.74 |
| 715 | Ac-ETF$r8EYWVQL$S-NH$_2$ | 1427 | 1633.84 | 817.92 | 817.36 |
| 716 | Ac-ETF$r8EHWAQL$A-NH$_2$ | 1428 | 1563.81 | 782.91 | 782.36 |
| 717 | Ac-ITF$r8EYWAQL$S-NH$_2$ | 1429 | 1589.85 | 795.93 | 795.38 |
| 718 | Ac-ITF$r8EHWVQL$A-NH$_2$ | 1430 | 1575.88 | 788.94 | 788.42 |
| 719 | Ac-ITF$r8EHWAQL$S-NH$_2$ | 1431 | 1563.85 | 782.93 | 782.43 |
| 720 | Ac-LTF4F$r8AYWAQCba$S-NH$_2$ | 1432 | 1561.83 | 781.92 | 781.32 |
| 721 | Ac-LTF3Cl$r8AYWAQhL$S-NH$_2$ | 1433 | 1579.82 | 790.91 | 790.64 |

TABLE 2b-continued

| SP | Sequence | SEQ ID NO: | Exact mass | M + 2 | Observed mass (m/e) |
|---|---|---|---|---|---|
| 722 | Ac-LTF3Cl$r8AYWAQCha$S-NH2 | 1434 | 1605.84 | 803.92 | 803.37 |
| 723 | Ac-LTF3Cl$r8AYWAQChg$S-NH2 | 1435 | 1591.82 | 796.91 | 796.27 |
| 724 | Ac-LTF3Cl$r8AYWAQCba$S-NH2 | 1436 | 1577.81 | 789.91 | 789.83 |
| 725 | Ac-LTF$r8AY6clWSQL$S-NH2 | 1437 | 1581.80 | 791.90 | 791.75 |
| 726 | Ac-LTF4F$r8HYWAQChL$S-NH2 | 1438 | 1629.87 | 815.94 | 815.36 |
| 727 | Ac-LTF4F$r8HYWAQCba$S-NH2 | 1439 | 1627.86 | 814.93 | 814.32 |
| 728 | Ac-LTF4F$r8AYWAQhL$S-NH2 | 1440 | 1563.85 | 782.93 | 782.36 |
| 729 | Ac-LTF4F$r8AYWAQChg$S-NH2 | 1441 | 1575.85 | 788.93 | 788.35 |
| 730 | Ac-ETF$r8EYWVAL$S-NH2 | 1442 | 1576.82 | 789.41 | 788.79 |
| 731 | Ac-ETF$r8EHWAAL$A-NH2 | 1443 | 1506.79 | 754.40 | 754.8 |
| 732 | Ac-ITF$r8EYWAAL$S-NH2 | 1444 | 1532.83 | 767.42 | 767.75 |
| 733 | Ac-ITF$r8EHWVAL$A-NH2 | 1445 | 1518.86 | 760.43 | 760.81 |
| 734 | Ac-ITF$r8EHWAAL$S-NH2 | 1446 | 1506.82 | 754.41 | 754.8 |
| 735 | Pam-LTF$r8EYWAQL$S-NH2 | 1447 | 1786.07 | 894.04 | 894.48 |
| 736 | Pam-ETF$r8EYWAQL$S-NH2 | 1448 | 1802.03 | 902.02 | 902.34 |
| 737 | Ac-LTF$r8AYWLQL$S-NH2 | 1449 | 1573.89 | 787.95 | 787.39 |
| 738 | Ac-LTF$r8EYWLQL$S-NH2 | 1450 | 1631.90 | 816.95 | 817.33 |
| 739 | Ac-LTF$r8EHWLQL$S-NH2 | 1451 | 1605.89 | 803.95 | 804.29 |
| 740 | Ac-LTF$r8VYWAQL$S-NH2 | 1452 | 1559.88 | 780.94 | 781.34 |
| 741 | Ac-LTF$r8AYWSQL$S-NH2 | 1453 | 1547.84 | 774.92 | 775.33 |
| 742 | Ac-ETF$r8AYWAQL$S-NH2 | 1454 | 1547.80 | 774.90 | 775.7 |
| 743 | Ac-LTF$r8EYWAQL$S-NH2 | 1455 | 1589.85 | 795.93 | 796.33 |
| 744 | Ac-LTF$r8HYWAQL$S-NHAm | 1456 | 1667.94 | 834.97 | 835.37 |
| 745 | Ac-LTF$r8HYWAQL$S-NHiAm | 1457 | 1667.94 | 834.97 | 835.27 |
| 746 | Ac-LTF$r8HYWAQL$S-NHnPr3Ph | 1458 | 1715.94 | 858.97 | 859.42 |
| 747 | Ac-LTF$r8HYWAQL$S-NHnBu3,3Me | 1459 | 1681.96 | 841.98 | 842.67 |
| 748 | Ac-LTF$r8HYWAQL$S-NHnBu | 1460 | 1653.93 | 827.97 | 828.24 |
| 749 | Ac-LTF$r8HYWAQL$S-NHnPr | 1461 | 1639.91 | 820.96 | 821.31 |
| 750 | Ac-LTF$r8HYWAQL$S-NHnEt2Ch | 1462 | 1707.98 | 854.99 | 855.35 |
| 751 | Ac-LTF$r8HYWAQL$S-NHHex | 1463 | 1681.96 | 841.98 | 842.4 |
| 752 | Ac-LTF$r8AYWAQL$S-NHmdPeg2 | 1464 | 1633.91 | 817.96 | 855.35 |
| 753 | Ac-LTF$r8AYWAQL$A-NHmdPeg2 | 1465 | 1617.92 | 809.96 | 810.58 |
| 754 | Ac-LTF$r5AYWAAL$s8S-NH2 | 1466 | 1474.82 | 738.41 | 738.79 |
| 755 | Ac-LTF$r8AYWCouQL$S-NH2 | 1467 | 1705.88 | 853.94 | 854.61 |
| 756 | Ac-LTF$r8CouYWAQL$S-NH2 | 1468 | 1705.88 | 853.94 | 854.7 |
| 757 | Ac-CouTF$r8AYWAQL$S-NH2 | 1469 | 1663.83 | 832.92 | 833.33 |
| 758 | H-LTF$r8AYWAQL$A-NH2 | 1470 | 1473.84 | 737.92 | 737.29 |
| 759 | Ac-HHF$r8AYWAQL$S-NH2 | 1471 | 1591.83 | 796.92 | 797.72 |

TABLE 2b-continued

| SP | Sequence | SEQ ID NO: | Exact mass | M + 2 | Observed mass (m/e) |
|---|---|---|---|---|---|
| 760 | Ac-LT2Nal$r8AYWSQL$S-NH$_2$ | 1472 | 1597.85 | 799.93 | 800.68 |
| 761 | Ac-LTF$r8HCouWAQL$S-NH$_2$ | 1473 | 1679.87 | 840.94 | 841.38 |
| 762 | Ac-LTF$r8AYWCou2QL$S-NH$_2$ | 1474 | 1789.94 | 895.97 | 896.51 |
| 763 | Ac-LTF$r8Cou2YWAQL$S-NH$_2$ | 1475 | 1789.94 | 895.97 | 896.5 |
| 764 | Ac-Cou2TF$r8AYWAQL$S-NH$_2$ | 1476 | 1747.90 | 874.95 | 875.42 |
| 765 | Ac-LTF$r8ACou2WAQL$S-NH$_2$ | 1477 | 1697.92 | 849.96 | 850.82 |
| 766 | Dmaac-LTF$r8AYWAQL$S-NH$_2$ | 1478 | 1574.89 | 788.45 | 788.82 |
| 767 | Hexac-LTF$r8AYWAQL$S-NH$_2$ | 1479 | 1587.91 | 794.96 | 795.11 |
| 768 | Napac-LTF$r8AYWAQL$S-NH$_2$ | 1480 | 1657.89 | 829.95 | 830.36 |
| 769 | Pam-LTF$r8AYWAQL$S-NH$_2$ | 1481 | 1728.06 | 865.03 | 865.45 |
| 770 | Ac-LT2Nal$r8HYAAQL$S-NH$_2$ | 1482 | 1532.84 | 767.42 | 767.61 |
| 771 | Ac-LT2Nal$/r8HYWAQLS/S-NH$_2$ | 1483 | 1675.91 | 838.96 | 839.1 |
| 772 | Ac-LT2Nal$r8HYFAQL$S-NH$_2$ | 1484 | 1608.87 | 805.44 | 805.9 |
| 773 | Ac-LT2Nal$r8HWAAQL$S-NH$_2$ | 1485 | 1555.86 | 778.93 | 779.08 |
| 774 | Ac-LT2Nal$r8HYAWQL$S-NH$_2$ | 1486 | 1647.88 | 824.94 | 825.04 |
| 775 | Ac-LT2Nal$r8HYAAQW$S-NH$_2$ | 1487 | 1605.83 | 803.92 | 804.05 |
| 776 | Ac-LTW$r8HYWAQL$S-NH$_2$ | 1488 | 1636.88 | 819.44 | 819.95 |
| 777 | Ac-LT1Nal$r8HYWAQL$S-NH$_2$ | 1489 | 1647.88 | 824.94 | 825.41 |

TABLE 2c shows examples of crosslinked and non-crosslinked polypeptides comprising D-amino acids.

TABLE 2c

| SP | Sequence | SEQ ID NO: | Iso-mer | Exact Mass | Found Mass | Calc (M+1)/1 | Calc (M+2)/2 | Calc (M+3)/3 |
|---|---|---|---|---|---|---|---|---|
| 765 | Ac-tawyanfekllr-NH$_2$ | 1490 | | | 777.46 | | | |
| 766 | Ac-tawyanf4CF3ekllr-NH$_2$ | 1491 | | | 811.41 | | | |

Example 2: Synthesis of Triazole-Crosslinked Peptidomimetic Macrocycles

In a typical example for the preparation of a peptidomimetic macrocycle comprising a 1,4-triazole group (e.g. SP153), 20% (v/v) 2,6-lutidine in DMF was added to the peptide resin (0.5 mmol) in a 40 ml glass vial and shaken for 10 minutes. Sodium ascorbate (0.25 g, 1.25 mmol) and diisopropylethylamine (0.22 ml, 1.25 mmol) were then added, followed by copper(I) iodide (0.24 g, 1.25 mmol) and the resulting reaction mixture was mechanically shaken 16 hours at ambient temperature.

In a typical example for the preparation of a peptidomimetic macrocycle comprising a 1,5-triazole group (SP932, SP933), a peptide resin (0.25 mmol) was washed with anhydrous DCM. Resin was loaded into a microwave vial. Vessel was evacuated and purged with nitrogen. Chloro(pentamethylcyclopentadienyl) bis(triphenylphosphine)ruthenium(II), 10% loading, (Strem 44-0117) was added. Anhydrous toluene was added to the reaction vessel. The reaction was then loaded into the microwave and held at 90° C. for 10 minutes. Reaction may need to be pushed a subsequent time for completion. In other cases, Chloro(1,5-cyclooctadiene)(pentamethylcyclopentadienyl)ruthenium ("Cp*RuCl(cod)") may be used, for example at room temperature in a solvent comprising toluene.

In a typical example for the preparation of a peptidomimetic macrocycle comprising an iodo-substituted triazole group (e.g. SP457), THF (2 ml) was added to the peptide resin (0.05 mmol) in a 40 ml glass vial and shaken for 10 minutes. N-bromosuccimide (0.04 g, 0.25 mmol), copper(I) iodide (0.05 g, 0.25 mmol) and diisopropylethylamine (0.04 ml, 0.25 mmol) were then added and the resulting reaction mixture was mechanically shaken 16 hours at ambient temperature. Iodo-triazole crosslinkers may be further substituted by a coupling reaction, for example with boronic acids, to result in a peptidomimetic macrocycle such as SP465. In a typical example, DMF (3 ml) was added to the iodo-triazole peptide resin (0.1 mmol) in a 40 ml glass vial and shaken for 10 minutes. Phenyl boronic acid (0.04 g, 0.3 mmol), tetrakis(triphenylphosphine)palladium(0) (0.006 g, 0.005 mmol) and potassium carbonate (0.083 g, 0.6 mmol)

were then added and the resulting reaction mixture was mechanically shaken 16 hours at 70° C. Iodo-triazole cross-linkers may also be further substituted by a coupling reaction, for example with a terminal alkyne (e.g. Sonogashira coupling), to result in a peptidomimetic macrocycle such as SP468. In a typical example, 2:1 THF:triethylamine (3 ml) was added to the iodo-triazole peptide resin (0.1 mmol) in a 40 ml glass vial and shaken for 10 minutes. N—BOC-4-pentyne-1-amine (0.04 g, 0.2 mmol) and bis(triphenylphosphine)palladiumchloride (0.014 g, 0.02 mmol) were added and shaken for 5 minutes. Copper(I) iodide (0.004 g, 0.02 mmol) was then added and the resulting reaction mixture was mechanically shaken 16 hours at 70° C.

The triazole-cyclized resin-bound peptides were deprotected and cleaved from the solid support by treatment with TFA/H$_2$O/TIS (95/5/5 v/v) for 2.5 h at room temperature. After filtration of the resin the TFA solution was precipitated in cold diethyl ether and centrifuged to yield the desired product as a solid. The crude product was purified by preparative HPLC. For example, purification of cross-linked compounds is achieved by high performance liquid chromatography (HPLC) (Varian ProStar) on a reverse phase C18 column (Varian) to yield the pure compounds. Chemical composition of the pure products is confirmed by LC/MS mass spectrometry (Micromass LCT interfaced with Agilent 1100 HPLC system) and amino acid analysis (Applied Biosystems, model 420A).

TABLE 3 and TABLE 3A show lists of peptidomimetic macrocycles of Formula I.

TABLE 3

| SP- | SEQ ID NO: | Sequence |
| --- | --- | --- |
| 778 | 1492 | Ac-F$4rn6AYWEAc3cL$4a5AAA-NH2 |
| 779 | 1493 | Ac-F$4rn6AYWEAc3cL$4a5AAibA-NH2 |
| 780 | 1494 | Ac-LTF$4rn6AYWAQL$4a5SANle-NH2 |
| 781 | 1495 | Ac-LTF$4rn6AYWAQL$4a5SAL-NH2 |
| 782 | 1496 | Ac-LTF$4rn6AYWAQL$4a5SAM-NH2 |
| 783 | 1497 | Ac-LTF$4rn6AYWAQL$4a5SAhL-NH2 |
| 784 | 1498 | Ac-LTF$4rn6AYWAQL$4a5SAF-NH2 |
| 785 | 1499 | Ac-LTF$4rn6AYWAQL$4a5SAI-NH2 |
| 786 | 1500 | Ac-LTF$4rn6AYWAQL$4a5SAChg-NH2 |
| 787 | 1501 | Ac-LTF$4rn6AYWAQL$4a5SAAib-NH2 |
| 788 | 1502 | Ac-LTF$4rn6AYWAQL$4a5SAA-NH2 |
| 789 | 1503 | Ac-LTF$4rn6AYWA$4a5L$S$Nle-NH2 |
| 790 | 1504 | Ac-LTF$4rn6AYWA$4a5L$S$A-NH2 |
| 791 | 1505 | Ac-F$4rn6AYWEAc3cL$4a5AANle-NH2 |
| 792 | 1506 | Ac-F$4rn6AYWEAc3cL$4a5AAL-NH2 |
| 793 | 1507 | Ac-F$4rn6AYWEAc3cL$4a5AAM-NH2 |
| 794 | 1508 | Ac-F$4rn6AYWEAc3cL$4a5AAhL-NH2 |
| 795 | 1509 | Ac-F$4rn6AYWEAc3cL$4a5AAF-NH2 |
| 796 | 1510 | Ac-F$4rn6AYWEAc3cL$4a5AAI-NH2 |

TABLE 3-continued

| SP- | SEQ ID NO: | Sequence |
| --- | --- | --- |
| 797 | 1511 | Ac-F$4rn6AYWEAc3cL$4a5AAChg-NH2 |
| 798 | 1512 | Ac-F$4rn6AYWEAc3cL$4a5AACha-NH2 |
| 799 | 1513 | Ac-F$4rn6AYWEAc3cL$4a5AAAib-NH2 |
| 800 | 1514 | Ac-LTF$4rn6AYWAQL$4a5AAAibV-NH2 |
| 801 | 1515 | Ac-LTF$4rn6AYWAQL$4a5AAAibV-NH2 |
| 802 | 1516 | Ac-LTF$4rn6AYWAQL$4a5SAibAA-NH2 |
| 803 | 1517 | Ac-LTF$4rn6AYWAQL$4a5SAibAA-NH2 |
| 804 | 1518 | Ac-HLTF$4rn6HHWHQL$4a5AANleNle-NH2 |
| 805 | 1519 | Ac-DLTF$4rn6HHWHQL$4a5RRLV-NH2 |
| 806 | 1520 | Ac-HHTF$4m6HHWHQL$4a5AAML-NH2 |
| 807 | 1521 | Ac-F$4rn6HHWHQL$4a5RRDCha-NH2 |
| 808 | 1522 | Ac-F$4rn6HHWHQL$4a5HRFV-NH2 |
| 809 | 1523 | Ac-HLTF$4rn6HHWHQL$4a5AAhLA-NH2 |
| 810 | 1524 | Ac-DLTF$4rn6HHWHQL$4a5RRChgl-NH2 |
| 811 | 1525 | Ac-DLTF$4rn6HHWHQL$4a5RRChgl-NH2 |
| 812 | 1526 | Ac-HHTF$4m6HHWHQL$4a5AAChav-NH2 |
| 813 | 1527 | Ac-F$4rn6HHWHQL$4a5RRDa-NH2 |
| 814 | 1528 | Ac-F$4rn6HHWHQL$4a5HRAibG-NH2 |
| 815 | 1529 | Ac-F$4rn6AYWAQL$4a5HHNleL-NH2 |
| 816 | 1530 | Ac-F$4rn6AYWSAL$4a5HQANle-NH2 |
| 817 | 1531 | Ac-F$4rn6AYWVQL$4a5QHChgl-NH2 |
| 818 | 1532 | Ac-F$4rn6AYWTAL$4a5QQNlev-NH2 |
| 819 | 1533 | Ac-F$4rn6AYWYQL$4a5HAibAa-NH2 |
| 820 | 1534 | Ac-LTF$4rn6AYWAQL$4a5HHLa-NH2 |
| 821 | 1535 | Ac-LTF$4rn6AYWAQL$4a5HHLa-NH2 |
| 822 | 1536 | Ac-LTF$4rn6AYWAQL$4a5HQNlev-NH2 |
| 823 | 1537 | Ac-LTF$4rn6AYWAQL$4a5HQNlev-NH2 |
| 824 | 1538 | Ac-LTF$4rn6AYWAQL$4a5QQMl-NH2 |
| 825 | 1539 | Ac-LTF$4rn6AYWAQL$4a5QQMl-NH2 |
| 826 | 1540 | Ac-LTF$4rn6AYWAQL$4a5HAibhLV-NH2 |
| 827 | 1541 | Ac-LTF$4rn6AYWAQL$4a5AHFA-NH2 |
| 828 | 1542 | Ac-HLTF$4rn6HHWHQL$4a5AANlel-NH2 |
| 829 | 1543 | Ac-DLTF$4rn6HHWHQL$4a5RRLa-NH2 |
| 830 | 1544 | Ac-HHTF$4m6HHWHQL$4a5AAMv-NH2 |
| 831 | 1545 | Ac-F$4rn6HHWHQL$4a5RRDA-NH2 |
| 832 | 1546 | Ac-F$4rn6HHWHQL$4a5HRFCha-NH2 |
| 833 | 1547 | Ac-F$4rn6AYWEAL$4a5AA-NHAm |
| 834 | 1548 | Ac-F$4rn6AYWEAL$4a5AA-NHiAm |

TABLE 3-continued

| SP- | SEQ ID NO: | Sequence |
|---|---|---|
| 835 | 1549 | Ac-F$4rn6AYWEAL$4a5AA-NHnPr3Ph |
| 836 | 1550 | Ac-F$4rn6AYWEAL$4a5AA-NHnBu33Me |
| 837 | 1551 | Ac-F$4rn6AYWEAL$4a5AA-NHnPr |
| 838 | 1552 | Ac-F$4rn6AYWEAL$4a5AA-NHnEt2Ch |
| 839 | 1553 | Ac-F$4rn6AYWEAL$4a5AA-NHnEt2Cp |
| 840 | 1554 | Ac-F$4rn6AYWEAL$4a5AA-NHHex |
| 841 | 1555 | Ac-LTF$4rn6AYWAQL$4a5AAIA-NH2 |
| 842 | 1556 | Ac-LTF$4rn6AYWAQL$4a5AAIA-NH2 |
| 843 | 1557 | Ac-LTF$4rn6AYWAAL$4a5AAMA-NH2 |
| 844 | 1558 | Ac-LTF$4rn6AYWAAL$4a5AAMA-NH2 |
| 845 | 1559 | Ac-LTF$4rn6AYWAQL$4a5AAIa-NH2 |
| 846 | 1560 | Ac-LTF$4rn6AYWAQL$4a5AAIa-NH2 |
| 847 | 1561 | Ac-LTF$4rn6AYWAAL$4a5AAMa-NH2 |
| 848 | 1562 | Ac-LTF$4rn6AYWAAL$4a5AAMa-NH2 |
| 849 | 1563 | Ac-LTF$4rn6AYWAAL$4a5AAIv-NH2 |
| 850 | 1564 | Ac-LTF$4rn6AYWAAL$4a5AAIv-NH2 |
| 851 | 1565 | Ac-LTF$4rn6AYWAAL$4a5AAMv-NH2 |
| 852 | 1566 | Ac-LTF$4rn6AYWAAL$4a5AANlev-NH2 |
| 853 | 1567 | Ac-LTF$4rn6AYWAAL$4a5AANlev-NH2 |
| 854 | 1568 | Ac-LTF$4rn6AYWAQL$4a5AAIl-NH2 |
| 855 | 1569 | Ac-LTF$4rn6AYWAQL$4a5AAIl-NH2 |
| 856 | 1570 | Ac-LTF$4rn6AYWAAL$4a5AAMl-NH2 |
| 857 | 1571 | Ac-LTF$4rn6AYWAQL$4a5AANlel-NH2 |
| 858 | 1572 | Ac-LTF$4rn6AYWAQL$4a5AANlel-NH2 |
| 859 | 1573 | Ac-F$4rn6AYWEAL$4a5AAMA-NH2 |
| 860 | 1574 | Ac-F$4rn6AYWEAL$4a5AANleA-NH2 |
| 861 | 1575 | Ac-F$4rn6AYWEAL$4a5AAIa-NH2 |
| 862 | 1576 | Ac-F$4rn6AYWEAL$4a5AAMa-NH2 |
| 863 | 1577 | Ac-F$4rn6AYWEAL$4a5AANlea-NH2 |
| 864 | 1578 | Ac-F$4rn6AYWEAL$4a5AAIv-NH2 |
| 865 | 1579 | Ac-F$4rn6AYWEAL$4a5AAMv-NH2 |
| 866 | 1580 | Ac-F$4rn6AYWEAL$4a5AANlev-NH2 |
| 867 | 1581 | Ac-F$4rn6AYWEAL$4a5AAIl-NH2 |
| 868 | 1582 | Ac-F$4rn6AYWEAL$4a5AAMl-NH2 |
| 869 | 1583 | Ac-F$4rn6AYWEAL$4a5AANlel-NH2 |
| 870 | 1584 | Ac-F$4rn6AYWEAL$4a5AANlel-NH2 |
| 871 | 1585 | Ac-LTF$4rn6AY6clWAQL$4a5SAA-NH2 |
| 872 | 1586 | Ac-LTF$4rn6AY6clWAQL$4a5SAA-NH2 |
| 873 | 1587 | Ac-WTF$4rn6FYWSQL$4a5AVAa-NH2 |
| 874 | 1588 | Ac-WTF$4rn6FYWSQL$4a5AVAa-NH2 |
| 875 | 1589 | Ac-WTF$4m6VYWSQL$4a5AVA-NH2 |
| 876 | 1590 | Ac-WTF$4m6VYWSQL$4a5AVA-NH2 |
| 877 | 1591 | Ac-WTF$4rn6FYWSQL$4a5SAAa-NH2 |
| 878 | 1592 | Ac-WTF$4rn6FYWSQL$4a5SAAa-NH2 |
| 879 | 1593 | Ac-WTF$4m6VYWSQL$4a5AVAaa-NH2 |
| 880 | 1594 | Ac-WTF$4m6VYWSQL$4a5AVAaa-NH2 |
| 881 | 1595 | Ac-LTF$4rn6AYWAQL$4a5AVG-NH2 |
| 882 | 1596 | Ac-LTF$4rn6AYWAQL$4a5AVG-NH2 |
| 883 | 1597 | Ac-LTF$4rn6AYWAQL$4a5AVQ-NH2 |
| 884 | 1598 | Ac-LTF$4rn6AYWAQL$4a5AVQ-NH2 |
| 885 | 1599 | Ac-LTF$4rn6AYWAQL$4a5SAa-NH2 |
| 886 | 1600 | Ac-LTF$4rn6AYWAQL$4a5SAa-NH2 |
| 887 | 1601 | Ac-LTF$4rn6AYWAQhL$4a5SAA-NH2 |
| 888 | 1602 | Ac-LTF$4rn6AYWAQhL$4a5SAA-NH2 |
| 889 | 1603 | Ac-LTF$4rn6AYWEQLStSA$4a5-NH2 |
| 890 | 1604 | Ac-LTF$4rn6AYWAQL$4a5SLA-NH2 |
| 891 | 1605 | Ac-LTF$4rn6AYWAQL$4a5SLA-NH2 |
| 892 | 1606 | Ac-LTF$4rn6AYWAQL$4a5SWA-NH2 |
| 893 | 1607 | Ac-LTF$4rn6AYWAQL$4a5SWA-NH2 |
| 894 | 1608 | Ac-LTF$4rn6AYWAQL$4a5SVS-NH2 |
| 895 | 1609 | Ac-LTF$4rn6AYWAQL$4a5SAS-NH2 |
| 896 | 1610 | Ac-LTF$4rn6AYWAQL$4a5SVG-NH2 |
| 897 | 1611 | Ac-ETF$4rn6VYWAQL$4a5SAa-NH2 |
| 898 | 1612 | Ac-ETF$4rn6VYWAQL$4a5SAA-NH2 |
| 899 | 1613 | Ac-ETF$4rn6VYWAQL$4a5SVA-NH2 |
| 900 | 1614 | Ac-ETF$4rn6VYWAQL$4a5SLA-NH2 |
| 901 | 1615 | Ac-ETF$4rn6VYWAQL$4a5SWA-NH2 |
| 902 | 1616 | Ac-ETF$4rn6KYWAQL$4a5SWA-NH2 |
| 903 | 1617 | Ac-ETF$4rn6VYWAQL$4a5SVS-NH2 |
| 904 | 1618 | Ac-ETF$4rn6VYWAQL$4a5SAS-NH2 |
| 905 | 1619 | Ac-ETF$4rn6VYWAQL$4a5SVG-NH2 |
| 906 | 1620 | Ac-LTF$4rn6VYWAQL$4a5SSa-NH2 |
| 907 | 1621 | Ac-ETF$4rn6VYWAQL$4a5SSa-NH2 |
| 908 | 1622 | Ac-LTF$4rn6VYWAQL$4a5SNa-NH2 |
| 909 | 1623 | Ac-ETF$4rn6VYWAQL$4a5SNa-NH2 |
| 910 | 1624 | Ac-LTF$4rn6VYWAQL$4a5SAa-NH2 |

TABLE 3-continued

| SP- | SEQ ID NO: | Sequence |
|---|---|---|
| 911 | 1625 | Ac-LTF$4rn6VYWAQL$4a5SVA-NH2 |
| 912 | 1626 | Ac-LTF$4rn6VYWAQL$4a5SVA-NH2 |
| 913 | 1627 | Ac-LTF$4rn6VYWAQL$4a5SWA-NH2 |
| 914 | 1628 | Ac-LTF$4rn6VYWAQL$4a5SVS-NH2 |
| 915 | 1629 | Ac-LTF$4rn6VYWAQL$4a5SVS-NH2 |
| 916 | 1630 | Ac-LTF$4rn6VYWAQL$4a5SAS-NH2 |
| 917 | 1631 | Ac-LTF$4rn6VYWAQL$4a5SAS-NH2 |
| 918 | 1632 | Ac-LTF$4rn6VYWAQL$4a5SVG-NH2 |
| 919 | 1633 | Ac-LTF$4rn6VYWAQL$4a5SVG-NH2 |
| 920 | 1634 | Ac-LTF$4rn6EYWAQCha$4a5SAA-NH2 |
| 921 | 1635 | Ac-LTF$4rn6EYWAQCha$4a5SAA-NH2 |
| 922 | 1636 | Ac-LTF$4rn6EYWAQCpg$4a5SAA-NH2 |
| 923 | 1637 | Ac-LTF$4rn6EYWAQCpg$4a5SAA-NH2 |
| 924 | 1638 | Ac-LTF$4rn6EYWAQF$4a5SAA-NH2 |
| 925 | 1639 | Ac-LTF$4rn6EYWAQF$4a5SAA-NH2 |
| 926 | 1640 | Ac-LTF3C1$4rn6EYWAQL$4a5SAA-NH2 |
| 927 | 1641 | Ac-LTF3C1$4rn6EYWAQL$4a5SAA-NH2 |
| 928 | 1642 | Ac-LTF34F2$4rn6EYWAQL$4a5SAA-NH2 |
| 929 | 1643 | Ac-LTF34F2$4rn6EYWAQL$4a5SAA-NH2 |
| 930 | 1644 | Ac-LTF34F2$4rn6EYWAQhL$4a5SAA-NH2 |
| 931 | 1645 | Ac-LTF34F2$4rn6EYWAQhL$4a5SAA-NH2 |
| 932 | 1646 | Ac-ETF$4rn6EYWAQL$4a5SAA-NH2 |
| 933 | 1647 | Ac-LTF$4rn6AYWVQL$4a5SAA-NH2 |
| 934 | 1648 | Ac-LTF$4rn6AHWQL$4a5SAA-NH2 |
| 935 | 1649 | Ac-LTF$4rn6AEWAQL$4a5SAA-NH2 |
| 936 | 1650 | Ac-LTF$4rn6ASWAQL$4a5SAA-NH2 |
| 937 | 1651 | Ac-LTF$4rn6AEWAQL$4a5SAA-NH2 |
| 938 | 1652 | Ac-LTF$4rn6ASWAQL$4a5SAA-NH2 |
| 939 | 1653 | Ac-LTF$4rn6AF4coohWAQL$4a5SAA-NH2 |
| 940 | 1654 | Ac-LTF$4rn6AF4coohWAQL$4a5SAA-NH2 |
| 941 | 1655 | Ac-LTF$4rn6AHWAQL$4a5AAIa-NH2 |
| 942 | 1656 | Ac-ITF$4rn6FYWAQL$4a5AAIa-NH2 |
| 943 | 1657 | Ac-1TF$4rn6EHWAQL$4a5AAIa-NH2 |
| 944 | 1658 | Ac-1TF$4rn6EHWAQL$4a5AAIa-NH2 |
| 945 | 1659 | Ac-ETF$4rn6EHWAQL$4a5AAIa-NH2 |
| 946 | 1660 | Ac-ETF$4rn6EHWAQL$4a5AAIa-NH2 |
| 947 | 1661 | Ac-LTF$4rn6AHWVQL$4a5AAIa-NH2 |
| 948 | 1662 | Ac-ITF$4rn6FYWVQL$4a5AAIa-NH2 |
| 949 | 1663 | Ac-ITF$4rn6EYWVQL$4a5AAIa-NH2 |
| 950 | 1664 | Ac-ITF$4rn6EHWVQL$4a5AAIa-NH2 |
| 951 | 1665 | Ac-LTF$4rn6AEWAQL$4a5AAIa-NH2 |
| 952 | 1666 | Ac-LTF$4rn6AF4coohWAQL$4a5AAIa-NH2 |
| 953 | 1667 | Ac-LTF$4rn6AF4coohWAQL$4a5AAIa-NH2 |
| 954 | 1668 | Ac-LTF$4rn6AHWAQL$4a5AHFA-NH2 |
| 955 | 1669 | Ac-ITF$4rn6FYWAQL$4a5AHFA-NH2 |
| 956 | 1670 | Ac-ITF$4rn6FYWAQL$4a5AHFA-NH2 |
| 957 | 1671 | Ac-ITF$4rn6FHWAQL$4a5AEFA-NH2 |
| 958 | 1672 | Ac-ITF$4rn6FHWAQL$4a5AEFA-NH2 |
| 959 | 1673 | Ac-ITF$4rn6EHWAQL$4a5AHFA-NH2 |
| 960 | 1674 | Ac-ITF$4rn6EHWAQL$4a5AHFA-NH2 |
| 961 | 1675 | Ac-LTF$4rn6AHWVQL$4a5AHFA-NH2 |
| 962 | 1676 | Ac-ITF$4rn6FYWVQL$4a5AHFA-NH2 |
| 963 | 1677 | Ac-ITF$4rn6EYWVQL$4a5AHFA-NH2 |
| 964 | 1678 | Ac-ITF$4rn6EHWVQL$4a5AHFA-NH2 |
| 965 | 1679 | Ac-ITF$4rn6EHWVQL$4a5AHFA-NH2 |
| 966 | 1680 | Ac-ETF$4rn6EYWAAL$4a5SAA-NH2 |
| 967 | 1681 | Ac-LTF$4rn6AYWVAL$4a5SAA-NH2 |
| 968 | 1682 | Ac-LTF$4rn6AHWAAL$4a5SAA-NH2 |
| 969 | 1683 | Ac-LTF$4rn6AEWAAL$4a5SAA-NH2 |
| 970 | 1684 | Ac-LTF$4rn6AEWAAL$4a5SAA-NH2 |
| 971 | 1685 | Ac-LTF$4rn6ASWAAL$4a5SAA-NH2 |
| 972 | 1686 | Ac-LTF$4rn6ASWAAL$4a5SAA-NH2 |
| 973 | 1687 | Ac-LTF$4rn6AYWAAL$4a5AAIa-NH2 |
| 974 | 1688 | Ac-LTF$4rn6AYWAAL$4a5AAIa-NH2 |
| 975 | 1689 | Ac-LTF$4rn6AYWAAL$4a5AHFA-NH2 |
| 976 | 1690 | Ac-LTF$4rn6EHWAQL$4a5AHIa-NH2 |
| 977 | 1691 | Ac-LTF$4rn6EHWAQL$4a5AHIa-NH2 |
| 978 | 1692 | Ac-LTF$4rn6AHWAQL$4a5AHIa-NH2 |
| 979 | 1693 | Ac-LTF$4rn6EYWAQL$4a5AHIa-NH2 |
| 980 | 1694 | Ac-LTF$4rn6AYWAQL$4a5AAFa-NH2 |
| 981 | 1695 | Ac-LTF$4rn6AYWAQL$4a5AAFa-NH2 |
| 982 | 1696 | Ac-LTF$4rn6AYWAQL$4a5AAWa-NH2 |
| 983 | 1697 | Ac-LTF$4rn6AYWAQL$4a5AAVa-NH2 |
| 984 | 1698 | Ac-LTF$4rn6AYWAQL$4a5AAVa-NH2 |
| 985 | 1699 | Ac-LTF$4rn6AYWAQL$4a5AALa-NH2 |
| 986 | 1700 | Ac-LTF$4rn6AYWAQL$4a5AALa-NH2 |

TABLE 3-continued

| SP- | SEQ ID NO: | Sequence |
|---|---|---|
| 987 | 1701 | Ac-LTF$rn6EYWAQL$4a5AAIa-NH2 |
| 988 | 1702 | Ac-LTF$rn6EYWAQL$4a5AAIa-NH2 |
| 989 | 1703 | Ac-LTF$rn6EYWAQL$4a5AAFa-NH2 |
| 990 | 1704 | Ac-LTF$rn6EYWAQL$4a5AAFa-NH2 |
| 991 | 1705 | Ac-LTF$rn6EYWAQL$4a5AAVa-NH2 |
| 992 | 1706 | Ac-LTF$rn6EYWAQL$4a5AAVa-NH2 |
| 993 | 1707 | Ac-LTF$rn6EHWAQL$4a5AAIa-NH2 |
| 994 | 1708 | Ac-LTF$rn6EHWAQL$4a5AAIa-NH2 |
| 995 | 1709 | Ac-LTF$rn6EHWAQL$4a5AAWa-NH2 |
| 996 | 1710 | Ac-LTF$rn6EHWAQL$4a5AAWa-NH2 |
| 997 | 1711 | Ac-LTF$rn6EHWAQL$4a5AALa-NH2 |
| 998 | 1712 | Ac-LTF$rn6EHWAQL$4a5AALa-NH2 |
| 999 | 1713 | Ac-ETF$rn6EHWVQL$4a5AALa-NH2 |
| 1000 | 1714 | Ac-LTF$rn6AYWAQL$4a5AAAa-NH2 |
| 1001 | 1715 | Ac-LTF$rn6AYWAQL$4a5AAAa-NH2 |
| 1002 | 1716 | Ac-LTF$rn6AYWAQL$4a5AAAibA-NH2 |
| 1003 | 1717 | Ac-LTF$rn6AYWAQL$4a5AAAibA-NH2 |
| 1004 | 1718 | Ac-LTF$rn6AYWAQL$4a5AAAAa-NH2 |
| 1005 | 1719 | Ac-LTF$r5AYWAQL$4a5s8AAIa-NH2 |
| 1006 | 1720 | Ac-LTF$r5AYWAQL$4a5s8SAA-NH2 |
| 1007 | 1721 | Ac-LTF$rn6AYWAQCba$4a5AANleA-NH2 |
| 1008 | 1722 | Ac-ETF$rn6AYWAQCba$4a5AANleA-NH2 |
| 1009 | 1723 | Ac-LTF$rn6EYWAQCba$4a5AANleA-NH2 |
| 1010 | 1724 | Ac-LTF$rn6AYWAQCba$4a5AWNleA-NH2 |
| 1011 | 1725 | Ac-ETF$rn6AYWAQCba$4a5AWNleA-NH2 |
| 1012 | 1726 | Ac-LTF$rn6EYWAQCba$4a5AWNleA-NH2 |
| 1013 | 1727 | Ac-LTF$rn6EYWAQCba$4a5SAFA-NH2 |
| 1014 | 1728 | Ac-LTF34F2$rn6EYWAQCba$4a5SANleA-NH2 |
| 1015 | 1729 | Ac-LTF$rn6EF4coohWAQCba$4a5SANleA-NH2 |
| 1016 | 1730 | Ac-LTF$rn6EYWSQCba$4a5SANleA-NH2 |
| 1017 | 1731 | Ac-LTF$rn6EYWWQCba$4a5SANleA-NH2 |
| 1018 | 1732 | Ac-LTF$rn6EYWAQCba$4a5AAIa-NH2 |
| 1019 | 1733 | Ac-LTF34F2$rn6EYWAQCba$4a5AAIa-NH2 |
| 1020 | 1734 | Ac-LTF$rn6EF4coohWAQCba$4a5AAIa-NH2 |
| 1021 | 1735 | Pam-ETF$4m6EYWAQCba$4a5SAA-NH2 |
| 1022 | 1736 | Ac-LThF$rn6EFWAQCba$4a5SAA-NH2 |
| 1023 | 1737 | Ac-LTF$rn6EYAAQCba$4a5SAA-NH2 |
| 1024 | 1738 | Ac-LTF$rn6EY2Na1AQCba$4a5SAA-NH2 |
| 1025 | 1739 | Ac-LTF$rn6AYWAQCba$4a5SAA-NH2 |
| 1026 | 1740 | Ac-LTF$rn6EYWAQCba$4a5SAF-NH2 |
| 1027 | 1741 | Ac-LTF$rn6AYWAQCba$4a5SAFa-NH2 |
| 1028 | 1742 | Ac-LTF$rn6AYWAQCba$4a5SAF-NH2 |
| 1029 | 1743 | Ac-LTF34F2$rn6AYWAQCba$4a5SAF-NH2 |
| 1030 | 1744 | Ac-LTF$rn6AF4coohWAQCba$4a5SAF-NH2 |
| 1031 | 1745 | Ac-LTF$rn6AY6clWAQCba$4a5SAF-NH2 |
| 1032 | 1746 | Ac-LTF$rn6AYWSQCba$4a5SAF-NH2 |
| 1033 | 1747 | Ac-LTF$rn6AYWWQCba$4a5SAF-NH2 |
| 1034 | 1748 | Ac-LTF$rn6AYWAQCba$4a5AAIa-NH2 |
| 1035 | 1749 | Ac-LTF34F2$rn6AYWAQCba$4a5AAIa-NH2 |
| 1036 | 1750 | Ac-LTF$rn6AY6clWAQCba$4a5AAIa-NH2 |
| 1037 | 1751 | Ac-LTF$rn6AF4coohWAQCba$4a5AAIa-NH2 |
| 1038 | 1752 | Ac-LTF$rn6EYWAQCba$4a5AAFa-NH2 |
| 1039 | 1753 | Ac-LTF$rn6EYWAQCba$4a5AAFa-NH2 |
| 1040 | 1754 | Ac-ETF$rn6AYWAQCba$4a5AWNlea-NH2 |
| 1041 | 1755 | Ac-LTF$rn6AYWAQCba$4a5AWNlea-NH2 |
| 1042 | 1756 | Ac-ETF$rn6EYWAQCba$4a5AWNlea-NH2 |
| 1043 | 1757 | Ac-ETF$rn6EYWAQCba$4a5AWNlea-NH2 |
| 1044 | 1758 | Ac-LTF$rn6AYWAQCba$4a5SAFa-NH2 |
| 1045 | 1759 | Ac-LTF$rn6AYWAQCba$4a5SAFa-NH2 |
| 1046 | 1760 | Ac-ETF$rn6AYWAQL$4a5AWNlea-NH2 |
| 1047 | 1761 | Ac-LTF$rn6EYWAQL$4a5AWNlea-NH2 |
| 1048 | 1762 | Ac-ETF$rn6EYWAQL$4a5AWNlea-NH2 |
| 1049 | 1763 | Dmaac-LTF$4m6EYWAQhL$4a5SAA-NH2 |
| 1050 | 1764 | Hexac-LTF$4m6EYWAQhL$4a5SAA-NH2 |
| 1051 | 1765 | Napac-LTF$4m6EYWAQhL$4a5SAA-NH2 |
| 1052 | 1766 | Decac-LTF$4m6EYWAQhL$4a5SAA-NH2 |
| 1053 | 1767 | Admac-LTF$rn6EYWAQhL$4a5SAA-NH2 |
| 1054 | 1768 | Tmac-LTF$4m6EYWAQhL$4a5SAA-NH2 |
| 1055 | 1769 | Pam-LTF$4m6EYWAQhL$4a5SAA-NH2 |
| 1056 | 1770 | Ac-LTF$rn6AYWAQCba$4a5AANleA-NH2 |
| 1057 | 1771 | Ac-LTF34F2$rn6EYWAQCba$4a5AAIa-NH2 |
| 1058 | 1772 | Ac-LTF34F2$rn6EYWAQCba$4a5SAA-NH2 |
| 1059 | 1773 | Ac-LTF34F2$rn6EYWAQCba$4a5SAA-NH2 |
| 1060 | 1774 | Ac-LTF$rn6EF4coohWAQCba$4a5SAA-NH2 |
| 1061 | 1775 | Ac-LTF$rn6EF4coohWAQCba$4a5SAA-NH2 |
| 1062 | 1776 | Ac-LTF$rn6EYWSQCba$4a5SAA-NH2 |

TABLE 3-continued

| SP- | SEQ ID NO: | Sequence |
|---|---|---|
| 1063 | 1777 | Ac-LTF$4rn6EYWSQCba$4a5SAA-NH2 |
| 1064 | 1778 | Ac-LTF$4rn6EYWAQhL$4a5SAA-NH2 |
| 1065 | 1779 | Ac-LTF$4rn6AYWAQhL$4a5SAF-NH2 |
| 1066 | 1780 | Ac-LTF$4rn6AYWAQhL$4a5SAF-NH2 |
| 1067 | 1781 | Ac-LTF34F2$4rn6AYWAQhL$4a5SAA-NH2 |
| 1068 | 1782 | Ac-LTF34F2$4rn6AYWAQhL$4a5SAA-NH2 |
| 1069 | 1783 | Ac-LTF$4rn6AF4coohWAQhL$4a5SAA-NH2 |
| 1070 | 1784 | Ac-LTF$4rn6AF4coohWAQhL$4a5SAA-NH2 |
| 1071 | 1785 | Ac-LTF$4rn6AYWSQhL$4a5SAA-NH2 |
| 1072 | 1786 | Ac-LTF$4rn6AYWSQhL$4a5SAA-NH2 |
| 1073 | 1787 | Ac-LTF$4rn6EYWAQL$4a5AANleA-NH2 |
| 1074 | 1788 | Ac-LTF34F2$4rn6AYWAQL$4a5AANleA-NH2 |
| 1075 | 1789 | Ac-LTF$4rn6AF4coohWAQL$4a5AANleA-NH2 |
| 1076 | 1790 | Ac-LTF$4rn6AYWSQL$4a5AANleA-NH2 |
| 1077 | 1791 | Ac-LTF34F2$4rn6AYWAQhL$4a5AANleA-NH2 |
| 1078 | 1792 | Ac-LTF34F2$4rn6AYWAQhL$4a5AANleA-NH2 |
| 1079 | 1793 | Ac-LTF$4rn6AF4coohWAQhL$4a5AANleA-NH2 |
| 1080 | 1794 | Ac-LTF$4rn6AF4coohWAQhL$4a5AANleA-NH2 |
| 1081 | 1795 | Ac-LTF$4rn6AYWSQhL$4a5AANleA-NH2 |
| 1082 | 1796 | Ac-LTF$4rn6AYWSQhL$4a5AANleA-NH2 |
| 1083 | 1797 | Ac-LTF$4rn6AYWAQhL$4a5AAAa-NH2 |
| 1084 | 1798 | Ac-LTF$4rn6AYWAQhL$4a5AAAAa-NH2 |
| 1085 | 1799 | Ac-LTF$4rn6AYWAQL$4a5AAAAAa-NH2 |
| 1086 | 1800 | Ac-LTF$4rn6AYWAQL$4a5AAAAAAa-NH2 |
| 1087 | 1801 | Ac-LTF$4rn6EYWAQhL$4a5AANleA-NH2 |
| 1088 | 1802 | Ac-AATF$4rn6AYWAQL$4a5AANleA-NH2 |
| 1089 | 1803 | Ac-LTF$4rn6AYWAQL$4a5AANleAA-NH2 |
| 1090 | 1804 | Ac-ALTF$4rn6AYWAQL$4a5AANleAA-NH2 |
| 1091 | 1805 | Ac-LTF$4rn6AYWAQCba$4a5AANleAA-NH2 |
| 1092 | 1806 | Ac-LTF$4rn6AYWAQhL$4a5AANleAA-NH2 |
| 1093 | 1807 | Ac-LTF$4rn6EYWAQCba$4a5SAAA-NH2 |
| 1094 | 1808 | Ac-LTF$4rn6EYWAQCba$4a5SAAA-NH2 |
| 1095 | 1809 | Ac-LTF$4rn6EYWAQCba$4a5SAAAA-NH2 |
| 1096 | 1810 | Ac-LTF$4rn6EYWAQCba$4a5SAAAA-NH2 |
| 1097 | 1811 | Ac-ALTF$4rn6EYWAQCba$4a5SAA-NH2 |
| 1098 | 1812 | Ac-ALTF$4rn6EYWAQCba$4a5SAAA-NH2 |
| 1099 | 1813 | Ac-ALTF$4rn6EYWAQCba$4a5SAA-NH2 |
| 1100 | 1814 | Ac-LTF$4rn6EY6clWAQCba$4a5SAA-NH2 |
| 1101 | 1815 | Ac-LTF$4rn6EF4cooh6clWAQCba$4a5SANleA-NH2 |
| 1102 | 1816 | Ac-LTF$4rn6EF4cooh6clWAQCba$4a5SANleA-NH2 |
| 1103 | 1817 | Ac-LTF$4rn6EF4cooh6clWAQCba$4a5AAIa-NH2 |
| 1104 | 1818 | Ac-LTF$4rn6EF4cooh6clWAQCba$4a5AAIa-NH2 |
| 1105 | 1819 | Ac-LTF$4rn6AY6clWAQL$4a5AAAAAa-NH2 |
| 1106 | 1820 | Ac-LTF$4rn6AY6clWAQL$4a5AAAAAa-NH2 |
| 1107 | 1821 | Ac-F$4rn6AY6clWEAL$4a5AAAAAAa-NH2 |
| 1108 | 1822 | Ac-ETF$4rn6EYWAQL$4a5AAAAAAa-NH2 |
| 1109 | 1823 | Ac-ETF$4rn6EYWAQL$4a5AAAAAAa-NH2 |
| 1110 | 1824 | Ac-LTF$4rn6EYWAQL$4a5AAAAAAa-NH2 |
| 1111 | 1825 | Ac-LTF$4rn6EYWAQL$4a5AAAAAAa-NH2 |
| 1112 | 1826 | Ac-LTF$4rn6AYWAQL$4a5AANleAa-NH2 |
| 1113 | 1827 | Ac-LTF$4rn6EYWAQL$4a5AANleAa-NH2 |
| 1114 | 1828 | Ac-LTF$4rn6EYWAQCba$4a5AAAAAa-NH2 |
| 1115 | 1829 | Ac-LTF$4rn6EYWAQCba$4a5AAAAAa-NH2 |
| 1116 | 1830 | Ac-LTF$4rn6EF4coohWAQCba$4a5AAAAAa-NH2 |
| 1117 | 1831 | Ac-LTF$4rn6EF4coohWAQCba$4a5AAAAAa-NH2 |
| 1118 | 1832 | Ac-LTF$4rn6EYWSQCba$4a5AAAAAa-NH2 |
| 1119 | 1833 | Ac-LTF$4rn6EYWSQCba$4a5AAAAAa-NH2 |
| 1120 | 1834 | Ac-LTF$4rn6EYWAQCba$4a5SAAa-NH2 |
| 1121 | 1835 | Ac-LTF$4rn6EYWAQCba$4a5SAAa-NH2 |
| 1122 | 1836 | Ac-ALTF$4rn6EYWAQCba$4a5SAAa-NH2 |
| 1123 | 1837 | Ac-ALTF$4rn6EYWAQCba$4a5SAAa-NH2 |
| 1124 | 1838 | Ac-ALTF$4rn6EYWAQCba$4a5SAAAa-NH2 |
| 1125 | 1839 | Ac-ALTF$4rn6EYWAQCba$4a5SAAAa-NH2 |
| 1126 | 1840 | Ac-AALTF$4rn6EYWAQCba$4a5SAAAa-NH2 |
| 1127 | 1841 | Ac-AALTF$4rn6EYWAQCba$4a5SAAAa-NH2 |
| 1128 | 1842 | Ac-RTF$4rn6EYWAQCba$4a5SAA-NH2 |
| 1129 | 1843 | Ac-LRF$4rn6EYWAQCba$4a5SAA-NH2 |
| 1130 | 1844 | Ac-LTF$4rn6EYWRQCba$4a5SAA-NH2 |
| 1131 | 1845 | Ac-LTF$4rn6EYWARCba$4a5SAA-NH2 |
| 1132 | 1846 | Ac-LTF$4rn6EYWAQCba$4a5RAA-NH2 |
| 1133 | 1847 | Ac-LTF$4rn6EYWAQCba$4a5SRA-NH2 |
| 1134 | 1848 | Ac-LTF$4rn6EYWAQCba$4a5SAR-NH2 |
| 1135 | 1849 | 5-FAM-BaLTF$4rn6AYWAQL$4a5AANleA-NH2 |

TABLE 3-continued

| SP- | SEQ ID NO: | Sequence |
|---|---|---|
| 1136 | 1850 | Ac-LAF$rn6EYWAQL$4a5AANleA-NH2 |
| 1137 | 1851 | Ac-ATF$rn6EYWAQL$4a5AANleA-NH2 |
| 1138 | 1852 | Ac-AAF$rn6EYWAQL$4a5AANleA-NH2 |
| 1139 | 1853 | Ac-AAAF$rn6EYWAQL$4a5AANleA-NH2 |
| 1140 | 1854 | Ac-AAAAF$rn6EYWAQL$4a5AANleA-NH2 |
| 1141 | 1855 | Ac-AATF$rn6EYWAQL$4a5AANleA-NH2 |
| 1142 | 1856 | Ac-AALTF$rn6EYWAQL$4a5AANleA-NH2 |
| 1143 | 1857 | Ac-AAALTF$rn6EYWAQL$4a5AANleA-NH2 |
| 1144 | 1858 | Ac-LTF$rn6EYWAQL$4a5AANleAA-NH2 |
| 1145 | 1859 | Ac-ALTF$rn6EYWAQL$4a5AANleAA-NH2 |
| 1146 | 1860 | Ac-AALTF$rn6EYWAQL$4a5AANleAA-NH2 |
| 1147 | 1861 | Ac-LTF$rn6EYWAQCba$4a5AANleAA-NH2 |
| 1148 | 1862 | Ac-LTF$rn6EYWAQhL$4a5AANleAA-NH2 |
| 1149 | 1863 | Ac-ALTF$rn6EYWAQhL$4a5AANleAA-NH2 |
| 1150 | 1864 | Ac-LTF$rn6ANmYWAQL$4a5AANleA-NH2 |
| 1151 | 1865 | Ac-LTF$rn6ANmYWAQL$4a5AANleA-NH2 |
| 1152 | 1866 | Ac-LTF$rn6AYNmWAQL$4a5AANleA-NH2 |
| 1153 | 1867 | Ac-LTF$rn6AYNmWAQL$4a5AANleA-NH2 |
| 1154 | 1868 | Ac-LTF$rn6AYAmwAQL$4a5AANleA-NH2 |
| 1155 | 1869 | Ac-LTF$rn6AYAmwAQL$4a5AANleA-NH2 |
| 1156 | 1870 | Ac-LTF$rn6AYWAibQL$4a5AANleA-NH2 |
| 1157 | 1871 | Ac-LTF$rn6AYWAibQL$4a5AANleA-NH2 |
| 1158 | 1872 | Ac-LTF$rn6AYWAQL$4a5AAibNleA-NH2 |
| 1159 | 1873 | Ac-LTF$rn6AYWAQL$4a5AAibNleA-NH2 |
| 1160 | 1874 | Ac-LTF$rn6AYWAQL$4a5ASarNleA-NH2 |
| 1161 | 1875 | Ac-LTF$rn6AYWAQL$4a5ASarNleA-NH2 |
| 1162 | 1876 | Ac-LTF$rn6AYWAQL$4a5AANleAib-NH2 |
| 1163 | 1877 | Ac-LTF$rn6AYWAQL$4a5AANleAib-NH2 |
| 1164 | 1878 | Ac-LTF$rn6AYWAQL$4a5AANleNmA-NH2 |
| 1165 | 1879 | Ac-LTF$rn6AYWAQL$4a5AANleNmA-NH2 |
| 1166 | 1880 | Ac-LTF$rn6AYWAQL$4a5AANleSar-NH2 |
| 1167 | 1881 | Ac-LTF$rn6AYWAQL$4a5AANleSar-NH2 |
| 1168 | 1882 | Ac-LTF$rn6AYWAQL$4a5AANleAAib-NH2 |
| 1169 | 1883 | Ac-LTF$rn6AYWAQL$4a5AANleAAib-NH2 |
| 1170 | 1884 | Ac-LTF$rn6AYWAQL$4a5AANleANmA-NH2 |
| 1171 | 1885 | Ac-LTF$rn6AYWAQL$4a5AANleANmA-NH2 |
| 1172 | 1886 | Ac-LTF$rn6AYWAQL$4a5AANleAa-NH2 |
| 1173 | 1887 | Ac-LTF$rn6AYWAQL$4a5AANleAa-NH2 |
| 1174 | 1888 | Ac-LTF$rn6AYWAQL$4a5AANleASar-NH2 |
| 1175 | 1889 | Ac-LTF$rn6AYWAQL$4a5AANleASar-NH2 |
| 1176 | 1890 | Ac-LTF$rn6Cou4YWAQL$4a5AANleA-NH2 |
| 1177 | 1891 | Ac-LTF$rn6Cou4YWAQL$4a5AANleA-NH2 |
| 1178 | 1892 | Ac-LTF$rn6AYWCou4QL$4a5AANleA-NH2 |
| 1179 | 1893 | Ac-LTF$rn6AYWAQL$4a5Cou4ANleA-NH2 |
| 1180 | 1894 | Ac-LTF$rn6AYWAQL$4a5Cou4ANleA-NH2 |
| 1181 | 1895 | Ac-LTF$rn6AYWAQL$4a5ACou4NleA-NH2 |
| 1182 | 1896 | Ac-LTF$rn6AYWAQL$4a5ACou4NleA-NH2 |
| 1183 | 1897 | Ac-LTF$rn6AYWAQL$4a5AANleA-OH |
| 1184 | 1898 | Ac-LTF$rn6AYWAQL$4a5AANleA-OH |
| 1185 | 1899 | Ac-LTF$rn6AYWAQL$4a5AANleA-NHnPr |
| 1186 | 1900 | Ac-LTF$rn6AYWAQL$4a5AANleA-NHnPr |
| 1187 | 1901 | Ac-LTF$rn6AYWAQL$4a5AANleA-NHnBu33Me |
| 1188 | 1902 | Ac-LTF$rn6AYWAQL$4a5AANleA-NHnBu33Me |
| 1189 | 1903 | Ac-LTF$rn6AYWAQL$4a5AANleA-NHHex |
| 1190 | 1904 | Ac-LTF$rn6AYWAQL$4a5AANleA-NHHex |
| 1191 | 1905 | Ac-LTA$rn6AYWAQL$4a5AANleA-NH2 |
| 1192 | 1906 | Ac-LThL$rn6AYWAQL$4a5AANleA-NH2 |
| 1193 | 1907 | Ac-LTF$rn6AYAAQL$4a5AANleA-NH2 |
| 1194 | 1908 | Ac-LTF$rn6AY2NalAQL$4a5AANleA-NH2 |
| 1195 | 1909 | Ac-LTF$rn6EYWCou4QCba$4a5SAA-NH2 |
| 1196 | 1910 | Ac-LTF$rn6EYWCou7QCba$4a5SAA-NH2 |
| 1197 | 1911 | Dmaac-LTF$m6EYWAQCba$4a5SAA-NH2 |
| 1198 | 1912 | Dmaac-LTF$m6AYWAQL$4a5AAAAAa-NH2 |
| 1199 | 1913 | Dmaac-LTF$m6EYWAQL$4a5AAAAAa-NH2 |
| 1200 | 1914 | Dmaac-LTF$m6EF4coohWAQCba$4a5AAIa-NH2 |
| 1201 | 1915 | Dmaac-LTF$m6EF4coohWAQCba$4a5AAIa-NH2 |
| 1202 | 1916 | Dmaac-LTF$rn6AYWAQL$4a5AANleA-NH2 |
| 1203 | 1917 | Cou6BaLTF$rn6EYWAQhL$4a5SAA-NH2 |
| 1204 | 1918 | Cou8BaLTF$rn6EYWAQhL$4a5SAA-NH2 |
| 1205 | 1919 | Ac-LTF4I$m6EYWAQL$4a5AAAAAa-NH2 |

TABLE 3A

| SP | SEQ ID NO: | Sequence | Exact Mass | Found Mass | Calc (M+1)/1 | Calc (M+2)/2 | Calc (M+3)/3 |
|---|---|---|---|---|---|---|---|
| 1206 | 1920 | Ac-LTF$4rn6AYWAQL$4a5AANleA-NH2 | 1812.01 | 907.89 | 1813.02 | 907.01 | 605.01 |
| 1207 | 1921 | Ac-LTF$4rn6AYWAQL$4a5AAAAAa-NH2 | 1912.04 | 957.75 | 1913.05 | 957.03 | 638.35 |
| 1208 | 1922 | Ac-LTF$4rn6EYWAQL$4a5AAAAAa-NH2 | 1970.04 | 986.43 | 1971.05 | 986.03 | 657.69 |
| 1209 | 1923 | Ac-LTF$5rn6AYWAQL$5a5AAAAAa-NH2 | 1912.04 | 957.38 | 1913.05 | 957.03 | 638.35 |
| 1210 | 1924 | Ac-LTF$4rn6EYWAQCba$4a5SAA-NH2 | 1784.93 | 894.38 | 1785.94 | 893.47 | 595.98 |
| 1211 | 1925 | Ac-LTF$4rn4EYWAQCba$4a5SAA-NH2 | 1756.89 | 880.05 | 1757.9 | 879.45 | 586.64 |
| 1212 | 1926 | Ac-LTF$4rn5EYWAQCba$4a5SAA-NH2 | 1770.91 | 887.08 | 1771.92 | 886.46 | 591.31 |
| 1213 | 1927 | Ac-LTF$5rn6EYWAQCba$5a5SAA-NH2 | 1784.92 | 894.11 | 1785.93 | 893.47 | 595.98 |
| 1214 | 1928 | Ac-LTF$4rn6EYWAQCba5I-$4a5SAA-NH2 | 1910.82 | 957.01 | 1911.83 | 956.42 | 637.95 |
| 1215 | 1929 | Ac-LTA$5m6EYWAQCba$5a5SAA-NH2 | 1708.89 | 856 | 1709.9 | 855.45 | 570.64 |
| 1216 | 1930 | Ac-LTA$4m6EYWAQCba$4a5SAA-NH2 | 1708.89 | 856 | 1709.9 | 855.45 | 570.64 |
| 1217 | 1931 | 5-FAM-BaLTF$4m6EYWAQCba$4a5SAA-NH2 | 2172 | 1087.81 | 2173.01 | 1087.01 | 725.01 |
| 1218 | 1932 | 5-FAM-BaLTA$4rn6EYWAQCba$4a5SAA-NH2 | 2095.97 | 1049.79 | 2096.98 | 1048.99 | 699.66 |
| 1219 | 1933 | 5-FAM-BaLTF$5m6EYWAQCba$5a5SAA-NH2 | 2172 | 1087.53 | 2173.01 | 1087.01 | 725.01 |
| 1220 | 1934 | 5-FAM-BaLTA$5rn6EYWAQCba$5a5SAA-NH2 | 2095.97 | 1049.98 | 2096.98 | 1048.99 | 699.66 |
| 1221 | 1935 | Ac-LTF$4rn6EYWAQCba5Ph-$4a5SAA-NH2 | 1675.87 | 932.31 | 1676.88 | 931.48 | 559.63 |
| 1222 | 1936 | Ac-LTF$4rn6EYWAQCba5Prp-$4a5SAA-NH2 | 1675.87 | 914.46 | 1676.88 | 913.48 | 559.63 |
| 1223 | 1937 | Ac-LTF$4rn6AYWAAL$4a5AAAAAa-NH2 | 1855.01 | | 1856.02 | 928.51 | 619.34 |
| 1224 | 1938 | Ac-LTF$4rn6EYWAQCba5penNH2-$4a5SAA-NH2 | 1675.87 | | 1676.88 | 838.94 | 559.63 |
| 1225 | 1939 | Ac-LTF$4rn6EYWAQCba5BnzNH2-$4a5SAA-NH2 | 1675.87 | | 1676.88 | 838.94 | 559.63 |
| 1226 | 1940 | Ac-LTF$4rn6EYWAQCba5prpOMe-$4a5SAA-NH2 | | 929.17 | | 928.48 | |
| 1227 | 1941 | Ac-LTF$5rn6EYWAQL4Me$5a5AAAAAa-NH2 | 1926.05 | | 1927.06 | 964.03 | 643.02 |
| 1228 | 1942 | Ac-LTF$5rn6EYWAQL4Ph$5a5AAAAAa-NH2 | 1988.07 | | 1989.07 | 995.04 | 663.70 |
| 1229 | 1943 | Ac-LTF$5rn6EYWAQCba4Me$5a5SAANH2 | 1740.93 | | 1741.94 | 871.48 | 581.32 |
| 1230 | 1944 | Ac-LTF$5rn6EYWAQCba4Ph$5a5SAANH2 | 1802.95 | | 1803.96 | 902.48 | 601.99 |

Example 3: Preparation of Peptidomimetic Macrocycles Using a Boc-Protected Amino Acid Peptidomimetic macrocycle precursors comprising an R8 amino acid at position "i" and an S5 amino acid at position "i+7" were prepared. The amino acid at position "i+3" was a Boc-protected tryptophan, which was incorporated during solid-phase synthesis. Specifically, the Boc-protected tryptophan amino acid shown below was used during solid phase synthesis:

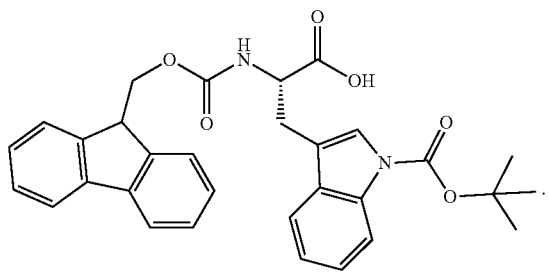 [SMILES: CC(C)(C)OC(=O)n1cc(C[C@H](NC(=O)OCC2c3ccccc3-c3ccccc32)C(=O)O)c2ccccc21]

Metathesis was performed using a ruthenium catalyst prior to the cleavage and deprotection steps. The composition obtained following cyclization was determined by HPLC analysis, and was found to contain primarily peptidomimetic macrocycles having a crosslinker comprising a trans olefin ("iso2", comprising the double bond in an E configuration). Unexpectedly, a ratio of 90:10 was observed for the trans and cis products, respectively.

Example 4: Preparation of Peptidomimetic Macrocycles Using a Boc-Protected Amino Acid Peptidomimetic macrocycles were first dissolved in neat N,N-dimethylacetamide (DMA) to make 20× stock solutions over a concentration range of 20-140 mg/mL. The DMA stock solutions were diluted 20-fold in an aqueous vehicle containing 2% Solutol-HS-15, 25 mM histidine, and 45 mg/mL mannitol to obtain final concentrations of 1-7 mg/ml of the peptidomimetic macrocycles in 5% DMA, 2% Solutol-HS-15, 25 mM histidine, and 45 mg/mL mannitol. The final solutions were mixed gently by repeat pipetting or light vortexing. The final solutions were sonicated for 10 min at room temperature in an ultrasonic water bath. Careful visual observations were performed under a hood light using a 7× visual amplifier to determine if precipitates existed on the bottom of the flasks or as a suspension. Additional concentration ranges were tested as needed to determine the maximum solubility limit for each peptidomimetic macrocycle.

Example 5: X-Ray Co-Crystallography of Peptidomimetic Macrocycles in Complex with MDMX For co-crystallization with peptide 46 (TABLE 2b), a stoichiometric amount of compound from a 100 mM stock solution in DMSO was added to a zebrafish MDMX protein solution. The solution was allowed to sit overnight at 4° C. before setting up crystallization experiments. Protein (residues 15-129, L46V/V95L) was obtained from an E. coli BL21 (DE3) expression system using the pET15b vector. Cells were grown at 37° C. and induced with 1 mM IPTG at an $OD_{600}$ of 0.7. Cells were allowed to grow an additional 18 hr at 23° C. The protein was purified using Ni-NT Agarose followed by Superdex 75 buffered with 50 mM $NaPO_4$, pH 8.0, 150 mM NaCl, and 2 mM TCEP, and concentrating to 24 mg/ml. The buffer was exchanged to 20 mM Tris, pH 8.0, 50 mM NaCl, and 2 mM DTT for crystallization experiments. Initial crystals were obtained with the Nextal AMS screen #94, and the final optimized reservoir was 2.6 M AMS, 75 mM Hepes, pH 7.5. Crystals grew routinely as thin plates at 4° C. and were cryoprotected by pulling the crystals through a solution containing concentrated (3.4 M) malonate followed by flash cooling, storage, and shipment in liquid nitrogen.

Data collection was performed at the APS at beamline 31-ID (SGX-CAT) at 100° K and wavelength 0.97929 Å. The beamline was equipped with a Rayonix 225-HE detector. For data collection, crystals were rotated through 180° in 1° increments using 0.8 second exposure times. Data were processed and reduced using Mosflm/scala (CCP4) in space group C2 (unit cell: a=109.2786, b=81.0836, c=30.9058 Å, α=90, β=89.8577, γ=90°). Molecular replacement with program Molrep (CCP4) was performed with the MDMX component of the structure, and two molecules were identified in the asymmetric unit. Initial refinement of just the two molecules of the zebrafish MDMX with program Refmac (CCP4) resulted in an R-factor of 0.3424 ($R_{free}$=0.3712) and rmsd values for bonds (0.018 Å) and angles (1.698°). The electron densities of the stapled peptide components, starting with $Gln^{19}$ and including the entire aliphatic staple, were very clear. Further refinement with CNX using data to 2.3 Å resolution resulted in a model (comprised of 1448 atoms from MDMX, 272 atoms from the stapled peptides and 46 water molecules) that was well refined ($R_f$=0.2601, $R_{free}$=0.3162, rmsd bonds=0.007 Å and rmsd angles=0.916°).

Example 6: Circular Dichroism (CD) Analysis of Alpha-Helicity

Peptide solutions were analyzed by CD spectroscopy using a spectropolarimeter. A temperature controller was used to maintain temperature control of the optical cell. Results are expressed as mean molar ellipticity [θ] (deg cm² dmol⁻¹) as calculated from the equation [θ]=θobs·MRW/10*l*c where θobs is the observed ellipticity in millidegrees, MRW is the mean residue weight of the peptide (peptide molecular weight/number of residues), l is the optical path length of the cell in centimeters, and c is the peptide concentration in mg/ml. Peptide concentrations were determined by amino acid analysis. Stock solutions of peptides were prepared in benign CD buffer (20 mM phosphoric acid, pH 2). The stock solutions were used to prepare peptide solutions of 0.05 mg/ml in either benign CD buffer or CD buffer with 50% trifluoroethanol (TFE) for analyses in a 10 mm path length cell. Variable wavelength measurements of peptide solutions were scanned at 4° C. from 195 to 250 nm, in 0.2 nm increments, and a scan rate 50 nm per minute. The average of six scans is reported.

TABLE 4 shows CD data for selected peptidomimetic macrocycles:

TABLE 4

| SP# | Molar Ellipticity Benign (222 in 0% TFE) | Molar Ellipticity 50% TFE (222 in 50% TFE) | Molar Ellipticity TFE-Molar Ellipticity Benign | % Helix 50% TFE compared to 50% TFE parent (CD) | % Helix benign compared to 50% TFE parent (CD) |
|---|---|---|---|---|---|
| 7 | 124 | −19921.4 | −20045.4 | 137.3 | −0.9 |
| 11 | −398.2 | −16623.4 | 16225.2 | 106.1 | 2.5 |
| 41 | −909 | −21319.4 | 20410.4 | 136 | 5.8 |
| 43 | −15334.5 | −18247.4 | 2912.9 | 116.4 | 97.8 |
| 69 | −102.6 | −21509.7 | −21407.1 | 148.2 | 0.7 |
| 71 | −121.2 | −17957 | −17835.9 | 123.7 | 0.8 |
| 154 | −916.2 | −30965.1 | −30048.9 | 213.4 | 6.3 |
| 230 | −213.2 | −17974 | −17760.8 | 123.9 | 1.5 |
| 233 | −477.9 | −19032.6 | −18554.7 | 131.2 | 3.3 |

Example 7: Direct Binding Assay MDM2 with Fluorescence Polarization (FP)

The assay was performed according to the following general protocol:
1. Dilute MDM2 (In-house, 41 kD) into FP buffer (High salt buffer-200 mM NaCl, 5 mM CHAPS, pH 7.5) to make 10 µM working stock solution.
2. Add 30 µl of 10 µM of protein stock solution into A1 and B1 well of 96-well black HE microplate (Molecular Devices).
3. Fill in 30 µl of FP buffer into column A2 to A12, B2 to B12, C1 to C12, and D1 to D12.
4. 2 or 3 fold series dilution of protein stock from A1, B1 into A2, B2; A2, B2 to A3, B3; to reach the single digit nM concentration at the last dilution point.
5. Dilute 1 mM (in 100% DMSO) of FAM labeled linear peptide with DMSO to 100 µM (dilution 1:10). Then, dilute from 100 µM to 10 µM with water (dilution 1:10) and then dilute with FP buffer from 10 µM to 40 nM (dilution 1:250). This is the working solution which is a 10 nM concentration in well (dilution 1:4). Keep the diluted FAM labeled peptide in the dark until use.
6. Add 10 µl of 10 nM of FAM labeled peptide into each well and incubate, and read at different time points. $K_D$ with 5-FAM-BaLTFEHYWAQLTS-NH$_2$ (SEQ ID NO: 1947) is ~13.38 nM.

Example 8: Competitive Fluorescence Polarization Assay for MDM2

MDM2 (41 kD) was diluted into FP buffer (high-salt buffer-200 mM NaCl, 5 mM CHAPS, pH 7.5) to make a 84 nM (2×) working stock solution. 20 µl of the 84 nM (2×) protein stock solution was added into each well of a 96-well black microplate. 1 mM of FAM-labeled linear peptide (in 100% DMSO) was diluted to 100 µM with DMSO (dilution 1:10). Then, diluted solution was further diluted from 100 µM to 10 µM with water (dilution 1:10), and diluted again with FP buffer from 10 µM to 40 nM (dilution 1:250). The resulting working solution resulted in a 10 nM concentration in each well (dilution 1:4). The diluted FAM-labeled peptides were kept in the dark until use.

Unlabeled peptide dose plates were prepared with FP buffer starting with 1 µM (final) of the peptide. 5-fold serial dilutions were made for 6 points using the following dilution scheme. 10 mM of the solution (in 100% DMSO) with DMSO to 5 mM (dilution 1:2); dilution from 5 mM to 500 µM with H$_2$O (dilution 1:10); and dilution with FP buffer from 500 µM to 20 µM (dilution 1:25). 5-fold serial dilutions from 4 µM (4×) were made for 6 points. 10 µl of the serial diluted unlabeled peptides were transferred to each well, which was filled with 20 µl of 84 nM of protein. 10 µl of 10 nM (4×) of FAM-labeled peptide was added into each well, and the wells were incubated for 3 h before being read.

Example 9: Direct Binding Assay MDMX with Fluorescence Polarization (FP)

MDMX (40 kD) was diluted into FP buffer (high-salt buffer-200 mM NaCl, 5 mM CHAPS, pH 7.5) to make a 10 µM working stock solution. 30 µl of the 10 µM of protein stock solution was added into the A1 and B1 wells of a 96-well black microplate. 30 µl of FP buffer was added to columns A2 to A12, B2 to B12, C1 to C12, and D1 to D12. 2-fold or 3-fold series dilutions of protein stocks were created from A1, B1 into A2, B2; A2, B2 to A3, B3; to reach the single digit nM concentration at the last dilution point. 1 mM (in 100% DMSO) of a FAM-labeled linear peptide was diluted with DMSO to 100 µM (dilution 1:10). The resulting solution was diluted from 100 µM to 10 µM with water (dilution 1:10), and diluted again with FP buffer from 10 µM to 40 nM (dilution 1:250). The working solution resulted in 10 nM concentration in each well (dilution 1:4). The FAM-labeled peptides were kept in the dark until use. 10 µl of the 10 nM FAM-labeled peptide was added into each well, and the plate was incubated and read at different time points. The $K_D$ with 5-FAM-BaLTFEHYWAQLTS-NH$_2$ (SEQ ID NO: 1947) was ~51 nM.

Example 10: Competitive Fluorescence Polarization Assay for MDMX

MDMX (40 kD) was diluted into FP buffer (high-salt buffer 200 mM NaCl, 5 mM CHAPS, pH 7.5) to make a 300 nM (2×) working stock solution. 20 µl of the 300 nM (2×) of protein stock solution was added into each well of 96-well black microplate. 1 mM (in 100% DMSO) of a FAM-labeled linear peptide was diluted with DMSO to a concentration of 100 µM (dilution 1:10). The solution was diluted from 100 M to 10 M with water (dilution 1:10), and diluted further with FP buffer from 10 µM to 40 nM (dilution 1:250). The final working solution resulted in a concentration of 10 nM per well (dilution 1:4). The diluted FAM-labeled peptide was kept in the dark until use. An unlabeled peptide dose plate was prepared with FP buffer starting with a concentration of 5 µM (final) of a peptide. 5-fold serial dilutions were prepared for 6 points using the following dilution scheme. 10 mM (in 100% DMSO) of the solution was diluted with DMSO to prepare a 5 mM (dilution 1:2) solution. The solution was diluted from 5 mM to 500 µM with H$_2$O (dilution 1:10), and diluted further with FP buffer from 500 µM to 20 µM (dilution 1:25). 5-fold serial dilutions from 20 µM (4×) were prepared for 6 points. 10 µl of the serially diluted unlabeled peptides were added to each well, which was filled with 20 µl of the 300 nM protein solution. 10 µl of the 10 nM (4×) FAM-labeled peptide solution was added into each well, and the wells were incubated for 3 h before reading.

Results from EXAMPLE 7-EXAMPLE 10 are shown in TABLE 5. The following scale is used: "+" represents a value greater than 1000 nM, "++" represents a value greater than 100 and less than or equal to 1000 nM, "+++" represents a value greater than 10 nM and less than or equal to 100 nM, and "++++" represents a value of less than or equal to 10 nM.

TABLE 5

| SP# | IC$_{50}$ (MDM2) | IC$_{50}$ (MDMX) | Ki (MDM2) | Ki (MDMX) |
|---|---|---|---|---|
| 3 | ++ | ++ | +++ | +++ |
| 4 | +++ | ++ | ++++ | +++ |
| 5 | +++ | ++ | ++++ | +++ |
| 6 | ++ | ++ | +++ | +++ |
| 7 | +++ | +++ | ++++ | +++ |
| 8 | ++ | ++ | +++ | +++ |
| 9 | ++ | ++ | +++ | +++ |
| 10 | ++ | ++ | +++ | +++ |
| 11 | +++ | ++ | ++++ | +++ |
| 12 | + | + | +++ | ++ |
| 13 | ++ | ++ | +++ | ++ |
| 14 | +++ | +++ | ++++ | ++++ |
| 15 | +++ | ++ | +++ | +++ |
| 16 | +++ | +++ | ++++ | +++ |
| 17 | +++ | +++ | ++++ | +++ |
| 18 | +++ | +++ | ++++ | ++++ |
| 19 | ++ | +++ | +++ | +++ |
| 20 | ++ | ++ | +++ | +++ |
| 21 | ++ | +++ | +++ | +++ |
| 22 | +++ | +++ | ++++ | +++ |
| 23 | ++ | ++ | +++ | +++ |
| 24 | +++ | ++ | ++++ | +++ |
| 26 | +++ | ++ | ++++ | +++ |
| 28 | +++ | +++ | ++++ | +++ |
| 30 | ++ | ++ | +++ | +++ |
| 32 | +++ | ++ | ++++ | +++ |
| 38 | + | ++ | ++ | +++ |
| 39 | + | ++ | ++ | ++ |
| 40 | ++ | ++ | ++ | +++ |
| 41 | ++ | +++ | +++ | +++ |
| 42 | ++ | ++ | +++ | ++ |
| 43 | +++ | +++ | ++++ | +++ |
| 45 | +++ | +++ | ++++ | ++++ |
| 46 | +++ | +++ | ++++ | +++ |
| 47 | ++ | ++ | +++ | +++ |
| 48 | ++ | ++ | +++ | +++ |
| 49 | ++ | ++ | +++ | +++ |
| 50 | +++ | ++ | ++++ | +++ |
| 52 | +++ | +++ | ++++ | ++++ |
| 54 | ++ | ++ | +++ | +++ |
| 55 | + | + | ++ | ++ |
| 65 | +++ | ++ | ++++ | +++ |
| 68 | ++ | ++ | +++ | +++ |
| 69 | +++ | ++ | ++++ | +++ |
| 70 | ++ | ++ | ++++ | +++ |
| 71 | +++ | ++ | ++++ | +++ |
| 75 | +++ | ++ | ++++ | +++ |
| 77 | +++ | ++ | ++++ | +++ |
| 80 | +++ | ++ | ++++ | +++ |
| 81 | ++ | ++ | +++ | +++ |
| 82 | ++ | ++ | +++ | +++ |
| 85 | +++ | ++ | ++++ | +++ |
| 99 | ++++ | ++ | ++++ | +++ |
| 100 | ++ | ++ | ++++ | +++ |
| 101 | +++ | ++ | ++++ | +++ |
| 102 | ++ | ++ | ++++ | +++ |
| 103 | ++ | ++ | ++++ | +++ |
| 104 | +++ | ++ | ++++ | +++ |
| 105 | +++ | ++ | ++++ | +++ |
| 106 | ++ | ++ | +++ | +++ |
| 107 | ++ | ++ | +++ | +++ |
| 108 | +++ | ++ | ++++ | +++ |
| 109 | +++ | ++ | ++++ | +++ |
| 110 | ++ | ++ | ++++ | +++ |
| 111 | ++ | ++ | ++++ | +++ |
| 112 | ++ | ++ | +++ | +++ |
| 113 | ++ | ++ | +++ | +++ |
| 114 | +++ | ++ | ++++ | +++ |
| 115 | ++++ | ++ | ++++ | +++ |
| 116 | + | + | ++ | ++ |
| 118 | ++++ | ++ | ++++ | +++ |
| 120 | +++ | ++ | ++++ | +++ |
| 121 | +++ | ++ | ++++ | +++ |
| 122 | ++++ | ++ | ++++ | +++ |
| 123 | ++++ | ++ | ++++ | +++ |
| 124 | ++++ | ++ | ++++ | +++ |
| 125 | ++++ | ++ | ++++ | +++ |
| 126 | ++++ | ++ | ++++ | +++ |
| 127 | ++++ | ++ | ++++ | +++ |
| 128 | ++++ | ++ | ++++ | +++ |
| 129 | ++++ | ++ | ++++ | +++ |
| 130 | ++++ | ++ | ++++ | +++ |
| 133 | ++++ | ++ | ++++ | +++ |
| 134 | ++++ | ++ | ++++ | +++ |
| 135 | ++++ | ++ | ++++ | +++ |
| 136 | ++++ | ++ | ++++ | +++ |
| 137 | ++++ | ++ | ++++ | +++ |
| 139 | ++++ | ++ | ++++ | +++ |
| 142 | ++++ | +++ | ++++ | +++ |
| 144 | ++++ | ++ | ++++ | +++ |
| 146 | ++++ | ++ | ++++ | +++ |
| 148 | ++++ | ++ | ++++ | +++ |
| 150 | ++++ | ++ | ++++ | +++ |
| 153 | ++++ | +++ | ++++ | +++ |
| 154 | ++++ | +++ | ++++ | ++++ |
| 156 | ++++ | ++ | ++++ | +++ |
| 158 | ++++ | ++ | ++++ | +++ |
| 160 | ++++ | ++ | ++++ | +++ |
| 161 | ++++ | ++ | ++++ | +++ |
| 166 | ++++ | ++ | ++++ | +++ |
| 167 | +++ | ++ | ++++ | ++ |
| 169 | ++++ | +++ | ++++ | +++ |
| 170 | ++++ | ++ | ++++ | +++ |
| 173 | ++++ | ++ | ++++ | +++ |
| 175 | ++++ | ++ | ++++ | +++ |
| 177 | +++ | ++ | ++++ | +++ |
| 180 | +++ | ++ | ++++ | +++ |
| 182 | ++++ | ++ | ++++ | +++ |
| 185 | +++ | + | ++++ | ++ |
| 186 | +++ | ++ | ++++ | +++ |
| 189 | +++ | ++ | ++++ | +++ |
| 192 | +++ | ++ | ++++ | +++ |
| 194 | +++ | ++ | ++++ | ++ |
| 196 | +++ | ++ | ++++ | +++ |
| 197 | ++++ | ++ | ++++ | +++ |
| 199 | +++ | ++ | ++++ | ++ |
| 201 | +++ | ++ | ++++ | ++ |
| 203 | +++ | ++ | ++++ | +++ |
| 204 | +++ | ++ | ++++ | +++ |
| 206 | +++ | ++ | ++++ | +++ |
| 207 | ++++ | ++ | ++++ | +++ |
| 210 | +++ | ++ | ++++ | +++ |
| 211 | ++++ | ++ | ++++ | +++ |
| 213 | ++++ | ++ | ++++ | +++ |
| 215 | +++ | ++ | ++++ | +++ |
| 217 | ++++ | ++ | ++++ | +++ |
| 218 | ++++ | ++ | ++++ | +++ |
| 221 | ++++ | +++ | ++++ | +++ |
| 227 | ++++ | ++ | ++++ | +++ |
| 230 | ++++ | +++ | ++++ | ++++ |
| 232 | ++++ | ++ | ++++ | +++ |
| 233 | ++++ | +++ | ++++ | +++ |
| 236 | +++ | ++ | ++++ | +++ |
| 237 | +++ | ++ | ++++ | +++ |
| 238 | +++ | +++ | ++++ | +++ |
| 239 | +++ | ++ | +++ | +++ |
| 240 | +++ | ++ | ++++ | +++ |
| 241 | +++ | ++ | ++++ | +++ |
| 242 | +++ | ++ | ++++ | +++ |
| 243 | +++ | +++ | ++++ | +++ |
| 244 | +++ | +++ | ++++ | ++++ |
| 245 | +++ | +++ | ++++ | +++ |
| 246 | +++ | ++ | ++++ | +++ |
| 247 | +++ | +++ | ++++ | +++ |
| 248 | +++ | +++ | ++++ | +++ |
| 249 | +++ | +++ | ++++ | ++++ |
| 250 | ++ | + | ++ | + |
| 252 | ++ | + | ++ | + |
| 254 | +++ | ++ | ++++ | +++ |
| 255 | +++ | +++ | ++++ | +++ |
| 256 | +++ | +++ | ++++ | +++ |
| 257 | +++ | +++ | ++++ | +++ |
| 258 | +++ | ++ | ++++ | +++ |
| 259 | +++ | +++ | ++++ | +++ |
| 260 | +++ | +++ | ++++ | +++ |
| 261 | +++ | ++ | ++++ | +++ |

TABLE 5-continued

| SP# | IC$_{50}$ (MDM2) | IC$_{50}$ (MDMX) | Ki (MDM2) | Ki (MDMX) |
|---|---|---|---|---|
| 262 | +++ | ++ | ++++ | +++ |
| 263 | +++ | ++ | ++++ | +++ |
| 264 | +++ | +++ | ++++ | +++ |
| 266 | +++ | ++ | ++++ | +++ |
| 267 | +++ | +++ | ++++ | ++++ |
| 270 | ++++ | +++ | ++++ | +++ |
| 271 | ++++ | +++ | ++++ | ++++ |
| 272 | ++++ | +++ | ++++ | ++++ |
| 276 | +++ | +++ | ++++ | ++++ |
| 277 | +++ | +++ | ++++ | ++++ |
| 278 | +++ | +++ | ++++ | ++++ |
| 279 | ++++ | +++ | ++++ | +++ |
| 280 | +++ | ++ | ++++ | +++ |
| 281 | +++ | + | +++ | ++ |
| 282 | ++ | + | +++ | + |
| 283 | +++ | ++ | +++ | ++ |
| 284 | +++ | ++ | ++++ | +++ |
| 289 | +++ | +++ | ++++ | +++ |
| 291 | +++ | +++ | ++++ | ++++ |
| 293 | ++++ | +++ | ++++ | +++ |
| 306 | ++++ | ++ | ++++ | +++ |
| 308 | ++ | ++ | +++ | +++ |
| 310 | +++ | +++ | ++++ | +++ |
| 312 | +++ | ++ | +++ | +++ |
| 313 | ++++ | ++ | ++++ | +++ |
| 314 | +++ | +++ | ++++ | ++++ |
| 315 | +++ | +++ | ++++ | +++ |
| 316 | ++++ | ++ | ++++ | +++ |
| 317 | +++ | ++ | +++ | +++ |
| 318 | +++ | ++ | +++ | +++ |
| 319 | +++ | ++ | +++ | ++ |
| 320 | +++ | ++ | +++ | ++ |
| 321 | +++ | ++ | ++++ | +++ |
| 322 | +++ | ++ | +++ | ++ |
| 323 | +++ | + | +++ | ++ |
| 328 | +++ | +++ | ++++ | +++ |
| 329 | +++ | +++ | ++++ | +++ |
| 331 | ++++ | +++ | ++++ | ++++ |
| 332 | ++++ | +++ | ++++ | ++++ |
| 334 | ++++ | +++ | ++++ | ++++ |
| 336 | ++++ | +++ | ++++ | ++++ |
| 339 | ++++ | ++ | ++++ | +++ |
| 341 | +++ | +++ | ++++ | ++++ |
| 343 | +++ | +++ | ++++ | ++++ |
| 347 | +++ | +++ | ++++ | +++ |
| 349 | ++++ | +++ | ++++ | ++++ |
| 351 | ++++ | +++ | ++++ | ++++ |
| 353 | ++++ | +++ | ++++ | ++++ |
| 355 | ++++ | +++ | ++++ | ++++ |
| 357 | ++++ | +++ | ++++ | ++++ |
| 359 | ++++ | +++ | ++++ | +++ |
| 360 | ++++ | ++++ | ++++ | ++++ |
| 363 | +++ | +++ | ++++ | ++++ |
| 364 | +++ | +++ | ++++ | ++++ |
| 365 | +++ | +++ | ++++ | ++++ |
| 366 | +++ | +++ | ++++ | +++ |
| 369 | ++ | ++ | +++ | +++ |
| 370 | +++ | +++ | ++++ | +++ |
| 371 | ++ | ++ | +++ | +++ |
| 372 | ++ | ++ | +++ | +++ |
| 373 | +++ | +++ | +++ | +++ |
| 374 | +++ | +++ | ++++ | ++++ |
| 375 | +++ | +++ | ++++ | ++++ |
| 376 | +++ | +++ | ++++ | ++++ |
| 377 | +++ | +++ | ++++ | +++ |
| 378 | +++ | +++ | ++++ | +++ |
| 379 | +++ | +++ | ++++ | +++ |
| 380 | +++ | +++ | ++++ | +++ |
| 381 | +++ | +++ | ++++ | +++ |
| 382 | +++ | +++ | ++++ | ++++ |
| 384 | ++ | + | ++ | + |
| 386 | ++ | + | ++ | + |
| 388 | ++ | +++ | +++ | ++++ |
| 390 | +++ | +++ | ++++ | +++ |
| 392 | +++ | +++ | ++++ | ++++ |
| 394 | ++++ | +++ | ++++ | ++++ |
| 396 | ++++ | ++++ | ++++ | ++++ |
| 398 | +++ | +++ | ++++ | +++ |
| 402 | ++++ | ++++ | ++++ | ++++ |
| 404 | +++ | +++ | ++++ | ++++ |
| 408 | +++ | +++ | ++++ | +++ |
| 410 | ++++ | ++++ | ++++ | ++++ |
| 411 | ++ | + | ++ | + |
| 412 | ++++ | +++ | ++++ | ++++ |
| 415 | ++++ | ++++ | ++++ | ++++ |
| 416 | +++ | +++ | ++++ | +++ |
| 417 | +++ | +++ | ++++ | +++ |
| 418 | ++++ | +++ | ++++ | ++++ |
| 419 | +++ | +++ | +++ | ++++ |
| 421 | ++++ | ++++ | ++++ | ++++ |
| 423 | +++ | +++ | ++++ | +++ |
| 425 | +++ | +++ | +++ | +++ |
| 427 | ++ | ++ | +++ | +++ |
| 432 | ++++ | +++ | ++++ | ++++ |
| 434 | +++ | +++ | ++++ | +++ |
| 435 | ++++ | +++ | ++++ | ++++ |
| 437 | +++ | +++ | ++++ | +++ |
| 439 | ++++ | +++ | ++++ | ++++ |
| 441 | ++++ | ++++ | ++++ | ++++ |
| 443 | +++ | +++ | ++++ | +++ |
| 445 | +++ | ++ | ++++ | +++ |
| 446 | +++ | + | ++++ | + |
| 447 | ++ | + | ++ | + |
| 551 | N/A | N/A | ++++ | +++ |
| 555 | N/A | N/A | ++++ | +++ |
| 556 | N/A | N/A | ++++ | +++ |
| 557 | N/A | N/A | +++ | +++ |
| 558 | N/A | N/A | +++ | +++ |
| 559 | N/A | N/A | +++ | +++ |
| 560 | N/A | N/A | + | + |
| 561 | N/A | N/A | ++++ | +++ |
| 562 | N/A | N/A | +++ | +++ |
| 563 | N/A | N/A | +++ | +++ |
| 564 | N/A | N/A | ++++ | +++ |
| 565 | N/A | N/A | +++ | +++ |
| 566 | N/A | N/A | ++++ | +++ |
| 567 | N/A | N/A | ++++ | +++ |
| 568 | N/A | N/A | ++++ | ++++ |
| 569 | N/A | N/A | ++++ | +++ |
| 570 | N/A | N/A | ++++ | +++ |
| 571 | N/A | N/A | ++++ | +++ |
| 572 | N/A | N/A | +++ | +++ |
| 573 | N/A | N/A | +++ | +++ |
| 574 | N/A | N/A | ++++ | +++ |
| 575 | N/A | N/A | ++++ | +++ |
| 576 | N/A | N/A | ++++ | +++ |
| 577 | N/A | N/A | ++++ | +++ |
| 578 | N/A | N/A | ++++ | +++ |
| 585 | N/A | N/A | +++ | +++ |
| 586 | N/A | N/A | ++++ | +++ |
| 587 | N/A | N/A | ++++ | ++++ |
| 589 | N/A | N/A | ++++ | |
| 594 | N/A | N/A | ++++ | ++++ |
| 596 | N/A | N/A | ++++ | +++ |
| 597 | N/A | N/A | ++++ | +++ |
| 598 | N/A | N/A | ++++ | +++ |
| 600 | N/A | N/A | ++++ | ++++ |
| 602 | N/A | N/A | ++++ | ++++ |
| 603 | N/A | N/A | ++++ | ++++ |
| 604 | N/A | N/A | +++ | +++ |
| 608 | N/A | N/A | ++++ | +++ |
| 609 | N/A | N/A | ++++ | +++ |
| 610 | N/A | N/A | ++++ | +++ |
| 611 | N/A | N/A | ++++ | +++ |
| 612 | N/A | N/A | ++++ | +++ |
| 613 | N/A | N/A | ++++ | +++ |
| 615 | N/A | N/A | ++++ | ++++ |
| 433 | N/A | N/A | ++++ | +++ |
| 686 | N/A | N/A | ++++ | +++ |
| 687 | N/A | N/A | ++ | ++ |
| 595 | N/A | N/A | + | N/A |
| 665 | N/A | N/A | +++ | N/A |
| 708 | N/A | N/A | +++ | +++ |
| 710 | N/A | N/A | +++ | +++ |
| 711 | N/A | N/A | +++ | ++ |
| 712 | N/A | N/A | ++++ | ++++ |

TABLE 5-continued

| SP# | IC$_{50}$ (MDM2) | IC$_{50}$ (MDMX) | Ki (MDM2) | Ki (MDMX) |
|---|---|---|---|---|
| 713 | N/A | N/A | ++++ | ++++ |
| 716 | N/A | N/A | ++++ | ++++ |
| 765 | + | + | | |
| 766 | +++ | + | | |
| 752 | ++ | + | | |
| 753 | +++ | + | | |
| 754 | ++ | + | | |
| 755 | ++++ | + | | |
| 756 | +++ | + | | |
| 757 | ++++ | + | | |
| 758 | +++ | + | | |

Example 11: Competition Binding ELISA Assay for MDM2 and MDMX p53-His6 protein ("His6" disclosed as SEQ ID NO: 1948) (30 nM/well) was coated overnight at room temperature in the wells of 96-well plates. On the day of the experiment, the plates were washed with 1×PBS-Tween 20 (0.05%) using an automated ELISA plate washer, and blocked with ELISA microwell blocking buffer for 30 minutes at room temperature. The excess blocking agent was washed off by washing the plates with 1×PBS-Tween 20 (0.05%). The peptides were diluted from 10 mM DMSO stock solutions to 500 µM working stock solutions using sterile water. Further dilutions were made in 0.5% DMSO to keep the concentration of DMSO constant across the samples. The peptide solutions were added to the wells at 2× the desired concentrations in 50 µL volumes, followed by addition of diluted GST-MDM2 or GST-HMDX protein (final concentration: 10 nM). The samples were incubated at room temperature for 2 h, and the plates were washed with PBS-Tween 20 (0.05%) prior to adding 100 µL of HRP-conjugated anti-GST antibody diluted to 0.5 µg/ml in HRP-stabilizing buffer. The plates were incubated with a detection antibody for 30 min, and the plates were washed and incubated with 100 µL per well of TMB-E substrate solution for up to 30 minutes. The reactions were stopped using 1M HCL, and absorbance was measured at 450 nm using a micro plate reader. The data were analyzed using Graph Pad PRISM software.

Example 12: Cell Viability Assay

Cells were trypsinized, counted, and seeded at pre-determined densities in 96-well plates one day prior to conducting the cell viability assay. The following cell densities were used for each cell line: SJSA-1: 7500 cells/well; RKO: 5000 cells/well; RKO-E6: 5000 cells/well; HCT-116: 5000 cells/well; SW-480: 2000 cells/well; and MCF7: 5000 cells/well. On the day of cell viability assay, the media was replaced with fresh media containing 11% FBS (assay media) at room temperature. 180 µL of the assay media was added to each well. Control wells were prepared with no cells, and the control wells received 200 µL of media.

Peptide dilutions were made at room temperature, and the diluted peptide solutions were added to the cells at room temperature. 10 mM stock solutions of the peptides were prepared in DMSO. The stock solutions were serially diluted using a 1:3 dilution scheme to obtain 10 mM, 3.3 mM, 1.1 mM, 0.33 mM, 0.11 mM, 0.03 mM, and 0.01 mM solutions in DMSO. The serially DMSO-diluted peptides were diluted 33.3 times using sterile water, resulting in a range of 10× working stock solutions. A DMSO/sterile water (3% DMSO) solution was prepared for use in the control well. The working stock solution concentrations ranges were 300 µM, 100 µM, 30 µM, 10 µM, 3 µM, 1 µM, 0.3 µM, and 0 µM. The solutions were mixed well at each dilution step using a multichannel pipette.

Row H of the plate contained the controls. Wells H1-H3 received 20 µL of assay media. Rows H4-H9 received 20 µL of the 3% DMSO-water vehicle. Wells H10-H12 received media alone control with no cells. The MDM2 small molecule inhibitor Nutlin-3a (10 mM) was used as a positive control. Nutlin-3a was diluted using the same dilution scheme used for the peptides.

20 µL of a 10× concentration peptide stock solution was added to the appropriate well to achieve the final concentration in 200 µL in each well. For example, 20 µL of 300 µM peptide solution+180 µL of cells in media=30 µM final concentration in 200 µL volume in wells. The solution was mixed gently a few times using a pipette. The final concentration range was 30 µM, 10 µM, 3 µM, 1 µM, 0.3 µM, 0.1 µM, 0.03 µM, and 0 µM. Further dilutions were used for potent peptides. Controls included wells that received no peptides, but contained the same concentration of DMSO as the wells containing peptides and wells containing no cells. The plates were incubated for 72 hours at 37° C. in a humidified 5% CO$_2$ atmosphere.

The viability of the cells was determined using MTT reagent. The viability of SJSA-1, RKO, RKO-E6, HCT-116 cells was determined on day 3. The viability of MCF7 cells was determined on day 5. The viability of SW-480 cells was determined on day 6. At the end of the designated incubation time, the plates were cooled to room temperature. 80 µL of assay media was removed from each well. 15 µL of thawed MTT reagent was then added to each well. The plate was incubated for 2 h at 37° C. in a humidified 5% CO$_2$ atmosphere. 100 µL of the solubilization reagent was added to each well. The plates were incubated with agitation for 1 h at room temperature, and read using a multiplate reader for absorbance at 570 nM. Cell viability was analyzed against the DMSO controls.

Results from cell viability assays are shown in TABLE 6 and TABLE 7. "+" represents a value greater than 30 µM, "++" represents a value greater than 15 µM and less than or equal to 30 µM, "+++" represents a value greater than 5 µM and less than or equal to 15 µM, and "++++" represents a value of less than or equal to 5 µM. "IC$_{50}$ ratio" represents the ratio of average IC$_{50}$ in p53+/+ cells relative to average IC$_{50}$ in p53−/− cells.

TABLE 6

| SP# | SJSA-1 EC50 (72 h) | SP# | SJSA-1 EC50 (72 h) | SP# | SJSA-1 EC50 (72 h) | SP# | SJSA-1 EC50 (72 h) |
|---|---|---|---|---|---|---|---|
| 3 | +++ | 170 | ++++ | 295 | +++ | 443 | ++++ |
| 4 | +++ | 171 | ++ | 296 | ++++ | 444 | +++ |
| 5 | ++++ | 173 | +++ | 297 | +++ | 445 | ++++ |
| 6 | ++ | 174 | ++++ | 298 | ++++ | 449 | ++++ |
| 7 | ++++ | 175 | +++ | 300 | ++++ | 551 | ++++ |
| 8 | +++ | 176 | +++ | 301 | ++++ | 552 | ++++ |
| 9 | +++ | 177 | ++++ | 302 | ++++ | 554 | + |
| 10 | +++ | 179 | +++ | 303 | ++++ | 555 | ++++ |
| 11 | ++++ | 180 | +++ | 304 | ++++ | 586 | ++++ |
| 12 | ++ | 181 | +++ | 305 | ++++ | 587 | ++++ |
| 13 | +++ | 182 | ++++ | 306 | ++++ | 588 | ++++ |
| 14 | + | 183 | ++++ | 307 | +++ | 589 | +++ |
| 15 | ++ | 184 | +++ | 308 | ++++ | 432 | ++++ |
| 16 | + | 185 | +++ | 309 | +++ | 672 | + |
| 17 | + | 186 | ++ | 310 | ++++ | 673 | ++ |
| 18 | + | 188 | ++ | 312 | ++++ | 682 | + |
| 19 | ++ | 190 | ++++ | 313 | ++++ | 686 | + |

TABLE 6-continued

| SP# | SJSA-1 EC50 (72 h) | SP# | SJSA-1 EC50 (72 h) | SP# | SJSA-1 EC50 (72 h) | SP# | SJSA-1 EC50 (72 h) |
|---|---|---|---|---|---|---|---|
| 20 | + | 192 | +++ | 314 | ++++ | 557 | ++++ |
| 21 | + | 193 | ++ | 315 | ++++ | 558 | ++++ |
| 22 | + | 194 | + | 316 | ++++ | 560 | + |
| 24 | +++ | 195 | ++++ | 317 | ++++ | 561 | ++++ |
| 26 | ++++ | 196 | ++++ | 318 | ++++ | 562 | ++++ |
| 28 | + | 197 | ++++ | 319 | ++++ | 563 | ++++ |
| 29 | + | 198 | ++ | 320 | ++++ | 564 | ++++ |
| 30 | + | 199 | +++ | 321 | ++++ | 566 | ++++ |
| 32 | ++ | 200 | +++ | 322 | ++++ | 567 | ++++ |
| 38 | + | 201 | ++++ | 323 | ++++ | 568 | +++ |
| 39 | + | 202 | +++ | 324 | ++++ | 569 | ++++ |
| 40 | + | 203 | ++++ | 326 | ++++ | 571 | ++++ |
| 41 | + | 204 | ++++ | 327 | ++++ | 572 | ++++ |
| 42 | + | 205 | ++ | 328 | ++++ | 573 | ++++ |
| 43 | ++ | 206 | ++ | 329 | ++++ | 574 | ++++ |
| 45 | + | 207 | +++ | 330 | ++++ | 575 | ++++ |
| 46 | + | 208 | +++ | 331 | ++++ | 576 | ++++ |
| 47 | + | 209 | ++++ | 332 | ++++ | 577 | ++++ |
| 48 | + | 210 | +++ | 333 | ++ | 578 | ++++ |
| 49 | +++ | 211 | ++++ | 334 | +++ | 585 | ++++ |
| 50 | ++++ | 213 | ++++ | 335 | ++++ | 687 | + |
| 52 | + | 214 | ++++ | 336 | ++++ | 662 | ++++ |
| 54 | + | 215 | ++++ | 337 | ++++ | 663 | ++++ |
| 55 | + | 216 | ++++ | 338 | ++++ | 553 | +++ |
| 65 | ++++ | 217 | ++++ | 339 | ++++ | 559 | ++++ |
| 68 | ++++ | 218 | ++++ | 340 | ++++ | 579 | ++++ |
| 69 | ++++ | 219 | ++++ | 341 | ++++ | 581 | ++++ |
| 70 | ++++ | 220 | +++ | 342 | ++++ | 582 | ++ |
| 71 | ++++ | 221 | ++++ | 343 | ++++ | 582 | ++++ |
| 72 | ++++ | 222 | +++ | 344 | ++++ | 584 | +++ |
| 74 | ++++ | 223 | ++++ | 345 | ++++ | 675 | ++++ |
| 75 | ++++ | 224 | ++ | 346 | ++++ | 676 | ++++ |
| 77 | ++++ | 225 | +++ | 347 | ++++ | 677 | + |
| 78 | ++ | 226 | ++ | 348 | ++++ | 679 | ++++ |
| 80 | ++++ | 227 | +++ | 349 | ++++ | 700 | +++ |
| 81 | +++ | 228 | ++++ | 350 | ++++ | 704 | +++ |
| 82 | +++ | 229 | ++++ | 351 | ++++ | 591 | + |
| 83 | +++ | 230 | ++++ | 352 | ++++ | 706 | ++ |
| 84 | + | 231 | ++++ | 353 | ++++ | 695 | ++ |
| 85 | +++ | 232 | ++++ | 355 | ++++ | 595 | ++++ |
| 99 | ++++ | 233 | ++++ | 357 | ++++ | 596 | ++++ |
| 102 | +++ | 234 | ++++ | 358 | ++++ | 597 | +++ |
| 103 | +++ | 235 | ++++ | 359 | ++++ | 598 | +++ |
| 104 | +++ | 236 | ++++ | 360 | ++++ | 599 | ++++ |
| 105 | +++ | 237 | ++++ | 361 | +++ | 600 | ++++ |
| 108 | +++ | 238 | ++++ | 362 | ++++ | 601 | +++ |
| 109 | +++ | 239 | +++ | 363 | ++++ | 602 | +++ |
| 110 | +++ | 240 | ++ | 364 | ++++ | 603 | +++ |
| 111 | ++ | 241 | +++ | 365 | +++ | 604 | +++ |
| 114 | ++++ | 242 | ++++ | 366 | ++++ | 606 | ++++ |
| 115 | ++++ | 243 | ++++ | 367 | ++++ | 607 | ++++ |
| 118 | ++++ | 244 | ++++ | 368 | + | 608 | ++++ |
| 120 | ++++ | 245 | ++++ | 369 | ++++ | 610 | ++++ |
| 121 | ++++ | 246 | +++ | 370 | ++++ | 611 | ++++ |
| 122 | ++++ | 247 | ++++ | 371 | ++++ | 612 | ++++ |
| 123 | ++++ | 248 | ++++ | 372 | +++ | 613 | +++ |
| 124 | +++ | 249 | ++++ | 373 | +++ | 614 | +++ |
| 125 | ++++ | 250 | ++ | 374 | ++++ | 615 | ++++ |
| 126 | ++++ | 251 | + | 375 | ++++ | 618 | ++++ |
| 127 | ++++ | 252 | + | 376 | ++++ | 619 | ++++ |
| 128 | +++ | 253 | + | 377 | ++++ | 707 | ++++ |
| 129 | ++ | 254 | +++ | 378 | ++++ | 620 | ++++ |
| 130 | ++++ | 255 | +++ | 379 | ++++ | 621 | ++++ |
| 131 | +++ | 256 | ++ | 380 | ++++ | 622 | ++++ |
| 132 | ++++ | 257 | +++ | 381 | ++++ | 623 | ++++ |
| 133 | +++ | 258 | +++ | 382 | ++++ | 624 | ++++ |
| 134 | +++ | 259 | ++ | 386 | +++ | 625 | ++++ |
| 135 | +++ | 260 | ++ | 388 | ++ | 626 | +++ |
| 136 | ++ | 261 | ++ | 390 | ++++ | 631 | ++++ |
| 137 | +++ | 262 | +++ | 392 | +++ | 633 | ++++ |
| 139 | ++++ | 263 | ++ | 394 | +++ | 634 | ++++ |
| 142 | +++ | 264 | ++++ | 396 | +++ | 635 | +++ |
| 144 | ++++ | 266 | +++ | 398 | +++ | 636 | +++ |
| 147 | ++++ | 267 | ++++ | 402 | +++ | 638 | + |
| 148 | ++++ | 270 | ++ | 404 | +++ | 641 | +++ |
| 149 | +++ | 271 | ++ | 408 | ++++ | 665 | ++++ |
| 150 | ++++ | 272 | ++ | 410 | +++ | 708 | ++++ |
| 152 | +++ | 276 | ++ | 411 | +++ | 709 | +++ |
| 153 | ++++ | 277 | ++ | 412 | + | 710 | + |
| 154 | ++++ | 278 | ++ | 421 | +++ | 711 | ++++ |
| 155 | ++ | 279 | ++ | 423 | ++++ | 712 | ++++ |
| 156 | +++ | 280 | +++ | 425 | ++++ | 713 | ++++ |
| 157 | +++ | 281 | ++ | 427 | ++++ | 714 | +++ |
| 158 | +++ | 282 | ++ | 434 | +++ | 715 | +++ |
| 160 | ++++ | 283 | ++ | 435 | ++++ | 716 | ++++ |
| 161 | ++++ | 284 | ++++ | 436 | ++++ | 765 | + |
| 162 | +++ | 289 | ++++ | 437 | ++++ | 753 | + |
| 163 | +++ | 290 | +++ | 438 | ++++ | 754 | + |
| 166 | ++ | 291 | ++++ | 439 | ++++ | 755 | + |
| 167 | +++ | 292 | ++++ | 440 | ++++ | 756 | + |
| 168 | ++ | 293 | ++++ | 441 | ++++ | 757 | ++++ |
| 169 | ++++ | 294 | ++++ | 442 | ++++ | 758 | +++ |

TABLE 7

| SP# | HCT-116 EC50 (72 h) | RKO EC50 (72 h) | RKO-E6 EC50 (72 h) | SW480 EC50 (6 days) | IC50 Ratio |
|---|---|---|---|---|---|
| 4 | ++++ | ++++ | +++ | ++++ | |
| 5 | ++++ | ++++ | +++ | ++++ | |
| 7 | ++++ | ++++ | +++ | ++++ | |
| 10 | ++++ | +++ | +++ | +++ | |
| 11 | ++++ | ++++ | ++ | +++ | |
| 50 | ++++ | ++++ | ++ | +++ | |
| 65 | +++ | +++ | +++ | +++ | |
| 69 | ++++ | ++++ | + | ++++ | |
| 70 | ++++ | ++++ | ++ | +++ | |
| 71 | ++++ | ++++ | +++ | +++ | |
| 81 | +++ | +++ | +++ | +++ | |
| 99 | ++++ | ++++ | +++ | ++++ | |
| 109 | ++++ | ++++ | ++ | +++ | |
| 114 | | +++ | + | +++ | |
| 115 | | +++ | + | +++ | 1-29 |
| 118 | +++ | ++++ | + | ++++ | |
| 120 | ++++ | ++++ | + | ++++ | |
| 121 | ++++ | ++++ | + | ++++ | |
| 122 | | +++ | + | +++ | 1-29 |
| 125 | +++ | +++ | + | + | |
| 126 | + | + | + | + | |
| 148 | | ++ | + | + | |
| 150 | | ++ | + | + | |
| 153 | +++ | | + | | |
| 154 | +++ | +++ | + | + | 30-49 |
| 158 | + | + | + | + | |
| 160 | +++ | + | + | + | 1-29 |
| 161 | +++ | + | + | + | |
| 175 | + | + | + | + | |
| 196 | ++++ | ++++ | +++ | ++++ | |
| 219 | ++++ | +++ | + | + | 1-29 |
| 233 | ++++ | | | | |
| 237 | ++++ | | + | + | |
| 238 | ++++ | | + | + | |
| 243 | ++++ | | + | + | |
| 244 | ++++ | | + | + | ≥50 |
| 245 | ++++ | | + | + | |
| 247 | ++++ | | + | + | |
| 249 | ++++ | ++++ | + | + | ≥50 |
| 255 | ++++ | | | + | |
| 291 | | | | + | |
| 293 | +++ | | | + | |
| 303 | +++ | | | + | 1-29 |
| 305 | | | | + | |
| 306 | ++++ | | | + | |
| 310 | ++++ | | | + | |
| 312 | ++++ | | | | |
| 313 | ++++ | | ++ | | |
| 314 | | | | + | |
| 315 | ++++ | ++++ | ++ | ++++ | ≥50 |
| 316 | ++++ | ++++ | + | +++ | ≥50 |

TABLE 7-continued

| SP# | HCT-116 EC50 (72 h) | RKO EC$_{50}$ (72 h) | RKO-E6 EC$_{50}$ (72 h) | SW480 EC50 (6 days) | IC$_{50}$ Ratio |
|---|---|---|---|---|---|
| 317 | +++ |  | + | ++ |  |
| 321 | ++++ |  | + |  |  |
| 324 | +++ |  | + |  |  |
| 325 | +++ |  |  |  |  |
| 326 | +++ |  | + |  |  |
| 327 | +++ |  | + |  |  |
| 328 | +++ |  | ++ |  |  |
| 329 | ++++ |  | + |  |  |
| 330 |  |  | + |  |  |
| 331 | ++++ | ++++ | + | + | ≥50 |
| 338 | ++++ | ++++ | ++ | +++ |  |
| 341 | +++ | ++ | + | + |  |
| 343 | +++ |  | + | + |  |
| 346 | ++++ |  | + | + |  |
| 347 | +++ |  | + | + |  |
| 349 | ++++ | +++ | + | + | 30-49 |
| 350 | ++++ |  | + | + |  |
| 351 | ++++ | +++ | + | + | 30-49 |
| 353 | ++ | ++ | + | + |  |
| 355 | ++++ | ++ | + | + | 1-29 |
| 357 | ++++ | ++++ | + | + |  |
| 358 | ++++ | ++ | + | + |  |
| 359 | ++++ | ++ | + | + |  |
| 367 | ++++ |  | + | + | 30-49 |
| 386 | ++++ | ++++ | ++++ | ++++ |  |
| 388 | ++ | ++ | + | +++ | 1-29 |
| 390 | ++++ | ++++ | +++ | ++++ |  |
| 435 | +++ | ++ | + |  |  |
| 436 | ++++ | ++++ | ++ |  |  |
| 437 | ++++ | ++++ | ++ | ++++ | 30-49 |
| 440 | ++ | ++ | + |  |  |
| 442 | ++++ | ++++ | ++ |  |  |
| 444 | ++++ | ++++ | +++ |  |  |
| 445 | ++++ | +++ | + | + | ≥50 |
| 555 |  |  |  |  | ≥50 |
| 557 |  |  |  |  | ≥50 |
| 558 |  |  |  |  | 30-49 |
| 562 |  |  |  |  | 30-49 |
| 564 |  |  |  |  | 30-49 |
| 566 |  |  |  |  | 30-49 |
| 567 |  |  |  |  | ≥50 |
| 572 |  |  |  |  | ≥50 |
| 573 |  |  |  |  | 30-49 |
| 578 |  |  |  |  | 30-49 |
| 662 |  |  |  |  | ≥50 |
| 379 |  |  |  |  | 1-29 |
| 375 |  |  |  |  | 1-29 |
| 559 |  |  |  |  | ≥50 |
| 561 |  |  |  |  | 1-29 |
| 563 |  |  |  |  | 1-29 |
| 568 |  |  |  |  | 1-29 |
| 569 |  |  |  |  | 1-29 |
| 571 |  |  |  |  | 1-29 |
| 574 |  |  |  |  | 1-29 |
| 575 |  |  |  |  | 1-29 |
| 576 |  |  |  |  | 1-29 |
| 577 |  |  |  |  | 30-49 |
| 433 |  |  |  |  | 1-29 |
| 551 |  |  |  |  | 30-49 |
| 553 |  |  |  |  | 1-29 |
| 710 |  |  |  | + |  |
| 711 |  |  |  | + |  |
| 712 |  |  |  | ++ |  |
| 713 |  |  |  | ++ |  |
| 714 |  |  |  | +++ |  |
| 715 |  |  |  | +++ |  |
| 716 |  |  |  | + |  |

Example 13: p21 ELISA Assay

SJSA-1 cells were trypsinized, counted, and seeded at a density of 7500 cells/100 µL/well in 96-well plates one day prior to running the assay. On the day of the assay, the media was replaced with fresh RPMI-11% FBS assay media. 90 µL of the assay media was added to each well. The control wells contained no cells and received 100 µL of the assay media.

10 mM stock solutions of the peptides were prepared in DMSO. The stock solutions were serially diluted using a 1:3 dilution scheme to obtain 10 mM, 3.3 mM, 1.1 mM, 0.33 mM, 0.11 mM, 0.03 mM, and 0.01 mM solutions in DMSO. The solutions were serially diluted 33.3 times using sterile water to provide a range of 10× working stock solutions. A DMSO/sterile water (3% DMSO) solution was prepared for use in the control wells. The working stock solution concentration range was 300 µM, 100 µM, 30 µM, 10 µM, 3 µM, 1 µM, 0.3 µM, and 0 µM. Each solution was mixed well at each dilution step using a multichannel pipette. Row H contained the control wells. Wells H1-H3 received 10 µL of the assay media. Wells H4-H9 received 10 µL of the 3% DMSO-water solution. Wells H10-H12 received media alone and contained no cells. The MDM2 small molecule inhibitor Nutlin-3a (10 mM) was used as a positive control. Nutlin-3a was diluted using the same dilution scheme used for the peptides.

10 µL of a 10× peptide solution was added to the appropriate well to achieve a final concentration in a volume of 100 µL. For example, 10 µL of 300 µM peptide+90 µL of cells in media=30 µM final concentration in 100 µL volume in wells. The final concentration range used was 30 µM, 10 µM, 3 µM, 1 µM, 0.3 µM, and 0 µM. Control wells included wells that did not receive peptides but contained the same concentration of DMSO as the wells containing the peptides and wells containing no cells.

20 h after incubation, the media was aspirated from the wells. The cells were washed with 1×PBS (without $Ca^{++}$/$Mg^{++}$) and lysed in 60 µL of 1× cell lysis buffer (10× buffer diluted to 1× and supplemented with protease inhibitors and phosphatase inhibitors) on ice for 30 min. The plates were centrifuged at 5000 rpm at 4° C. for 8 min. The clear supernatants were collected and frozen at −80° C. until further use. The total protein contents of the lysates were measured using a BCA protein detection kit and BSA standards. Each well provided about 6-7 µg of protein. 50 µL of the lysate was used per well to set up the p21 ELISA assay. For the human total p21 ELISA assay, 50 µL of lysate was used for each well, and each well was set up in triplicate.

Example 14: Caspase 3 Detection Assay

SJSA-1 cells were trypsinized, counted, and seeded at a density of 7500 cells/100 µL/well in 96-well plates one day prior to conducting the assay. One the day of the assay, the media was replaced with fresh RPMI-11% FBS assay media. 180 µL of the assay media was added to each well. Control wells contained no cells, and received 200 µL of the assay media.

10 mM stock solutions of the peptides were prepared in DMSO. The stock solutions were serially diluted using a 1:3 dilution scheme to obtain 10 mM, 3.3 mM, 1.1 mM, 0.33 mM, 0.11 mM, 0.03 mM, and 0.01 mM solutions in DMSO. The solutions were serially diluted 33.3 times using sterile water to provide a range of 10× working stock solutions. A DMSO/sterile water (3% DMSO) solution was prepared for use in the control wells. The working stock solution concentration range was 300 µM, 100 µM, 30 µM, 10 µM, 3 µM, 1 µM, 0.3 µM, and 0 µM. Each well was mixed well at each dilution step using a multichannel pipette. 20 µL of the 10× working stock solutions were added to the appropriate wells. Row H of the plates had control wells. Wells H1-H3 received 20 µL of the assay media. Wells H4-H9 received 20 µL of the 3% DMSO-water solutions. Wells H10-H12 received media and had no cells. The MDM2 small molecule inhibitor Nutlin-3a (10 mM) was used as a positive control. Nutlin-3a was diluted using the same dilution scheme as the peptides.

10 μL of the 10× stock solutions were added to the appropriate wells to achieve the final concentrations in a total volume of 100 μL. For example, 10 μL of 300 μM peptide+90 μL of cells in media=30 μM final concentration in 100 μL volume in wells. The final concentration range used was 30 μM, 10 μM, 3 μM, 1 μM, 0.3 μM, and 0 μM. Control wells contained no peptides but contained the same concentration of DMSO as the wells containing the peptides and well containing no cells. 48 h after incubation, 80 μL of the media was aspirated from each well. 100 μL of Caspase 3/7Glo assay reagent was added to each well. The plates were incubated with gentle shaking for 1 h at room temperature and read using a multi-plate reader for luminescence. Data were analyzed as Caspase 3 activation over DMSO-treated cells. Results from EXAMPLE 13 and EXAMPLE 14 are shown in TABLE 8.

TABLE 8

| SP# | caspase 0.3 μM | caspase 1 μM | caspase 3 μM | caspase 10 μM | caspase 30 μM | p21 0.3 μM | p21 1 μM | p21 3 μM | p21 10 μM | p21 30 μM |
|---|---|---|---|---|---|---|---|---|---|---|
| 4 | | | 9 | 37 | 35 | | | 317 | 3049 | 3257 |
| 7 | 0.93 | 1.4 | 5.08 | 21.7 | 23.96 | | 18 | 368 | 1687 | 2306 |
| 8 | | | 1 | 19 | 25 | | | 34 | 972 | 2857 |
| 10 | 1 | | 1 | 17 | 32 | | 10 | 89 | 970 | 2250 |
| 11 | 1 | | 5 | 23 | 33.5 | | 140 | 350 | 2075.5 | 3154 |
| 26 | 1 | | 1 | 3 | 14 | | | | | |
| 50 | | | 8 | 29 | 29 | | 44 | 646 | 1923 | 1818 |
| 65 | 1 | | 6 | 28 | 34 | −69 | −24 | 122 | 843 | 1472 |
| 69 | 4.34 | 9.51 | 16.39 | 26.59 | 26.11 | 272 | 458.72 | 1281.39 | 2138.88 | 1447.22 |
| 70 | | | 1 | 9 | 26 | | −19 | 68 | 828 | 1871 |
| 71 | 0.95 | 1.02 | 3.68 | 14.72 | 23.52 | | 95 | 101 | 1204 | 2075 |
| 72 | 1 | | 1 | 4 | 10 | −19 | 57 | 282 | 772 | 1045 |
| 77 | 1 | | 2 | 19 | 23 | | | | | |
| 80 | 1 | | 2 | 13 | 20 | | | | | |
| 81 | 1 | | 1 | 6 | 21 | | 0 | 0 | 417 | 1649 |
| 99 | 1 | | 7 | 31 | 33 | −19 | 117 | 370 | 996 | 1398 |
| 109 | | | 4 | 16 | 25 | | 161 | 445 | 1221 | 1680 |
| 114 | 1 | | 6 | 28 | 34 | −21 | 11 | 116 | 742 | 910 |
| 115 | 1 | | 10 | 26 | 32 | −10 | 36 | 315 | 832 | 1020 |
| 118 | 1 | | 2 | 18 | 27 | −76 | −62 | −11 | 581 | 1270 |
| 120 | 2 | | 11 | 20 | 30 | −4 | 30 | 164 | 756 | 1349 |
| 121 | 1 | | 5 | 19 | 30 | 9 | 33 | 81 | 626 | 1251 |
| 122 | 1 | | 2 | 15 | 30 | −39 | −18 | 59 | 554 | 1289 |
| 123 | 1 | | 1 | 6 | 14 | | | | | |
| 125 | 1 | | 3 | 9 | 29 | 50 | 104 | 196 | 353 | 1222 |
| 126 | 1 | | 1 | 6 | 30 | −47 | −10 | 90 | 397 | 1443 |
| 127 | 1 | | 1 | 4 | 13 | | | | | |
| 130 | 1 | | 2 | 6 | 17 | | | | | |
| 139 | 1 | | 2 | 9 | 18 | | | | | |
| 142 | 1 | | 2 | 15 | 20 | | | | | |
| 144 | 1 | | 4 | 10 | 16 | | | | | |
| 148 | 1 | | 11 | 23 | 31 | −23 | 55 | 295 | 666 | 820 |
| 149 | 1 | | 2 | 4 | 10 | 35 | 331 | 601 | 1164 | 1540 |
| 150 | 2 | | 11 | 19 | 35 | −37 | 24 | 294 | 895 | 906 |
| 153 | 2 | | 10 | 15 | 20 | | | | | |
| 154 | 2.68 | 4 | 13.93 | 19.86 | 30.14 | 414.04 | 837.45 | 1622.42 | 2149.51 | 2156.98 |
| 158 | 1 | | 1.67 | 5 | 16.33 | −1.5 | 95 | 209.5 | 654 | 1665.5 |
| 160 | 2 | | 10 | 16 | 31 | −43 | 46 | 373 | 814 | 1334 |
| 161 | 2 | | 8 | 14 | 22 | 13 | 128 | 331 | 619 | 1078 |
| 170 | 1 | | 1 | 16 | 20 | | | | | |
| 175 | 1 | | 5 | 12 | 21 | −65 | 1 | 149 | 543 | 1107 |
| 177 | 1 | | 1 | 8 | 20 | | | | | |
| 183 | 1 | | 1 | 4 | 8 | −132 | −119 | −14 | 1002 | 818 |
| 196 | 1 | | 4 | 33 | 26 | −49 | −1 | 214 | 1715 | 687 |
| 197 | 1 | | 1 | 10 | 20 | | | | | |
| 203 | 1 | | 3 | 12 | 10 | 77 | 329 | 534 | 1805 | 380 |
| 204 | 1 | | 4 | 10 | 10 | 3 | 337 | 928 | 1435 | 269 |
| 218 | 1 | | 2 | 8 | 18 | | | | | |
| 219 | 1 | | 5 | 17 | 34 | 28 | 53 | 289 | 884 | 1435 |
| 221 | 1 | | 3 | 6 | 12 | 127 | 339 | 923 | 1694 | 1701 |
| 223 | 1 | | 1 | 5 | 18 | | | | | |
| 230 | 1 | | 2 | 3 | 11 | 245.5 | 392 | 882 | 1549 | 2086 |
| 233 | 6 | 8 | 17 | 22 | 23 | 2000 | 2489 | 3528 | 3689 | 2481 |
| 237 | 1 | | 5 | 9 | 15 | 0 | 0 | 2 | 284 | 421 |
| 238 | 1 | | 2 | 4 | 21 | 0 | 149 | 128 | 825 | 2066 |
| 242 | 1 | | 4 | 5 | 18 | 0 | 0 | 35 | 577 | 595 |
| 243 | 1 | | 2 | 5 | 23 | 0 | 0 | 0 | 456 | 615 |
| 244 | 1 | | 2 | 7 | 17 | 0 | 178 | 190 | 708 | 1112 |
| 245 | 1 | | 3 | 9 | 16 | 0 | 0 | 0 | 368 | 536 |
| 247 | 1 | | 3 | 11 | 24 | 0 | 0 | 49 | 492 | 699 |
| 248 | | | | | | 0 | 50 | 22 | 174 | 1919 |
| 249 | 2 | | 5 | 11 | 23 | 0 | 0 | 100 | 907 | 1076 |
| 251 | | | | | | 0 | 0 | 0 | 0 | 0 |
| 252 | | | | | | 0 | 0 | 0 | 0 | 0 |

TABLE 8-continued

| SP# | caspase 0.3 µM | caspase 1 µM | caspase 3 µM | caspase 10 µM | caspase 30 µM | p21 0.3 µM | p21 1 µM | p21 3 µM | p21 10 µM | p21 30 µM |
|---|---|---|---|---|---|---|---|---|---|---|
| 253 | | | | | | 0 | 0 | 0 | 0 | 0 |
| 254 | 1 | 3 | 7 | 14 | 22 | 118 | 896 | 1774 | 3042 | 3035 |
| 286 | 1 | 4 | 11 | 20 | 22 | 481 | 1351 | 2882 | 3383 | 2479 |
| 287 | 1 | 1 | 3 | 11 | 23 | 97 | 398 | 986 | 2828 | 3410 |
| 315 | 11 | 14.5 | 25.5 | 32 | 34 | 2110 | 2209 | 2626 | 2965 | 2635 |
| 316 | 6.5 | 10.5 | 21 | 32 | 32.5 | 1319 | 1718 | 2848 | 2918 | 2540 |
| 317 | 3 | 4 | 9 | 26 | 35 | 551 | 624 | 776 | 1367 | 1076 |
| 331 | 4.5 | 8 | 11 | 14.5 | 30.5 | 1510 | 1649 | 2027 | 2319 | 2509 |
| 338 | 1 | 5 | 23 | 20 | 29 | 660.37 | 1625.38 | 3365.87 | 2897.62 | 2727 |
| 341 | 3 | 8 | 11 | 14 | 21 | 1325.62 | 1873 | 2039.75 | 2360.75 | 2574 |
| 343 | 1 | 1 | 2 | 5 | 29 | 262 | 281 | 450 | 570 | 1199 |
| 346 | | | | | | 235.86 | 339.82 | 620.36 | 829.32 | 1695.78 |
| 347 | 2 | 3 | 5 | 8 | 29 | 374 | 622 | 659 | 905 | 1567 |
| 349 | 1 | 8 | 11 | 16 | 24 | 1039.5 | 1598.88 | 1983.75 | 2191.25 | 2576.38 |
| 351 | 3 | 9 | 13 | 15 | 24 | 1350.67 | 1710.67 | 2030.92 | 2190.67 | 2668.54 |
| 353 | 1 | 2 | 5 | 7 | 30 | 390 | 490 | 709 | 931 | 1483 |
| 355 | 1 | 4 | 11 | 13 | 30 | 191 | 688 | 1122 | 1223 | 1519 |
| 357 | 2 | 7 | 11 | 15 | 23 | 539 | 777 | 1080 | 1362 | 1177 |
| 358 | 1 | 2 | 3 | 6 | 24 | 252 | 321 | 434 | 609 | 1192 |
| 359 | 3 | 9 | 11 | 13 | 23 | 1163.29 | 1508.79 | 1780.29 | 2067.67 | 2479.29 |
| 416 | | | | | | 33.74 | 39.82 | 56.57 | 86.78 | 1275.28 |
| 417 | | | | | | 0 | 0 | 101.13 | 639.04 | 2016.58 |
| 419 | | | | | | 58.28 | 97.36 | 221.65 | 1520.69 | 2187.94 |
| 432 | | | | | | 54.86 | 68.86 | 105.11 | 440.28 | 1594.4 |

Example 15: Cell Lysis by Peptidomimetic Macrocycles

SJSA-1 cells were plated out one day in advance in clear, flat-bottom plates at a density of 7500 cells/well with 100 µL/well of growth media. Row H columns 10-12 were left empty to be treated with media alone. On the day of the assay, the media was exchanged with RPMI 1% FBS media to result in 90 µL of media per well. 10 mM stock solutions of the peptidomimetic macrocycles were prepared in 100% DMSO. The peptidomimetic macrocycles were diluted serially in 100% DMSO, and further diluted 20-fold in sterile water to prepare working stock solutions in 5% DMSO/water. The concentrations of the peptidomimetic macrocycles ranged from 500 µM to 62.5 µM.

10 µL of each compound solution was added to the 90 µL of SJSA-1 cells to yield final concentration of 50 µM to 6.25 µM in 0.5% DMSO-containing media. The negative control (non-lytic sample) was 0.5% of DMSO alone. The positive control (lytic) samples included 10 µM of Melittin and 1% Triton X-100. The cell plates were incubated for 1 h at 37° C. After incubation for 1 h, the morphology of the cells was examined by microscope. The plates were then centrifuged at 1200 rpm for 5 min at room temperature. 40 µL of the supernatant for each peptidomimetic macrocycle and control sample was transferred to clear assay plates. LDH release was measured using an LDH cytotoxicity assay kit. The results of the cell lysis assay are shown in TABLE 9:

TABLE 9

| SP# | 6.25 µM % Lysed cells (1 h LDH) | 12.5 µM % Lysed cells (1 h LDH) | 25 µM % Lysed cells (1 h LDH) | 50 µM % Lysed cells (1 h LDH) |
|---|---|---|---|---|
| 3 | 1 | 0 | 1 | 3 |
| 4 | −2 | 1 | 1 | 2 |
| 6 | 1 | 1 | 1 | 1 |
| 7 | 0 | 0 | 0 | 0 |
| 8 | −1 | 0 | 1 | 1 |
| 9 | −3 | 0 | 0 | 2 |
| 11 | −2 | 1 | 2 | 3 |
| 15 | 1 | 2 | 2 | 5 |
| 18 | 0 | 1 | 2 | 4 |
| 19 | 2 | 2 | 3 | 21 |
| 22 | 0 | −1 | 0 | 0 |
| 26 | 2 | 5 | −1 | 0 |
| 32 | 0 | 0 | 2 | 0 |
| 39 | 0 | −1 | 0 | 3 |
| 43 | 0 | 0 | −1 | −1 |
| 55 | 1 | 5 | 9 | 13 |
| 65 | 0 | 0 | 0 | 2 |
| 69 | 1 | 0.5 | −0.5 | 5 |
| 71 | 0 | 0 | 0 | 0 |
| 72 | 2 | 1 | 0 | 3 |
| 75 | −1 | 3 | 1 | 1 |
| 77 | −2 | −2 | 1 | −1 |
| 80 | 0 | 1 | 1 | 5 |
| 81 | 1 | 1 | 0 | 0 |
| 82 | 0 | 0 | 0 | 1 |
| 99 | 1.5 | 3 | 2 | 3.5 |
| 108 | 0 | 0 | 0 | 1 |
| 114 | 3 | −1 | 4 | 9 |
| 115 | 0 | 1 | −1 | 6 |
| 118 | 4 | 2 | 2 | 4 |
| 120 | 0 | −1 | 0 | 6 |
| 121 | 1 | 0 | 1 | 7 |
| 122 | 1 | 3 | 0 | 6 |
| 123 | −2 | 2 | 5 | 3 |
| 125 | 0 | 1 | 0 | 2 |
| 126 | 1 | 2 | 1 | 1 |
| 130 | 1 | 3 | 0 | −1 |
| 139 | −2 | −3 | −1 | −1 |
| 142 | 1 | 0 | 1 | 3 |
| 144 | 1 | 2 | −1 | 2 |
| 147 | 8 | 9 | 16 | 55 |
| 148 | 0 | 1 | −1 | 0 |
| 149 | 6 | 7 | 7 | 21 |
| 150 | −1 | −2 | 0 | 2 |
| 153 | 4 | 3 | 2 | 3 |
| 154 | −1 | −1.5 | −1 | −1 |
| 158 | 0 | −6 | −2 | |
| 160 | −1 | 0 | −1 | 1 |
| 161 | 1 | 1 | −1 | 0 |
| 169 | 2 | 3 | 3 | 7 |

TABLE 9-continued

| SP# | 6.25 µM % Lysed cells (1 h LDH) | 12.5 µM % Lysed cells (1 h LDH) | 25 µM % Lysed cells (1 h LDH) | 50 µM % Lysed cells (1 h LDH) |
|---|---|---|---|---|
| 170 | 2 | 2 | 1 | −1 |
| 174 | 5 | 3 | 2 | 5 |
| 175 | 3 | 2 | 1 | 0 |
| 177 | −1 | −1 | 0 | 1 |
| 182 | 0 | 2 | 3 | 6 |
| 183 | 2 | 1 | 0 | 3 |
| 190 | −1 | −1 | 0 | 1 |
| 196 | 0 | −2 | 0 | 3 |
| 197 | 1 | −4 | −1 | −2 |
| 203 | 0 | −1 | 2 | 2 |
| 204 | 4 | 3 | 2 | 0 |
| 211 | 5 | 4 | 3 | 1 |
| 217 | 2 | 1 | 1 | 2 |
| 218 | 0 | −3 | −4 | 1 |
| 219 | 0 | 0 | −1 | 2 |
| 221 | 3 | 3 | 3 | 11 |
| 223 | −2 | −2 | −4 | −1 |
| 230 | 0.5 | −0.5 | 0 | 3 |
| 232 | 6 | 6 | 5 | 5 |
| 233 | 2.5 | 4.5 | 3.5 | 6 |
| 237 | 0 | 3 | 7 | 55 |
| 243 | 4 | 23 | 39 | 64 |
| 244 | 0 | 1 | 0 | 4 |
| 245 | 1 | 14 | 11 | 56 |
| 247 | 0 | 0 | 0 | 4 |
| 249 | 0 | 0 | 0 | 0 |
| 254 | 11 | 34 | 60 | 75 |
| 279 | 6 | 4 | 5 | 6 |
| 280 | 5 | 4 | 6 | 18 |
| 284 | 5 | 4 | 5 | 6 |
| 286 | 0 | 0 | 0 | 0 |
| 287 | 0 | 6 | 11 | 56 |
| 316 | 0 | 1 | 0 | 1 |
| 317 | 0 | 1 | 0 | 0 |
| 331 | 0 | 0 | 0 | 0 |
| 335 | 0 | 0 | 0 | 1 |
| 336 | 0 | 0 | 0 | 0 |
| 338 | 0 | 0 | 0 | 1 |
| 340 | 0 | 2 | 0 | 0 |
| 341 | 0 | 0 | 0 | 0 |
| 343 | 0 | 1 | 0 | 0 |
| 347 | 0 | 0 | 0 | 0 |
| 349 | 0 | 0 | 0 | 0 |
| 351 | 0 | 0 | 0 | 0 |
| 353 | 0 | 0 | 0 | 0 |
| 355 | 0 | 0 | 0 | 0 |
| 357 | 0 | 0 | 0 | 0 |
| 359 | 0 | 0 | 0 | 0 |
| 413 | 5 | 3 | 3 | 3 |
| 414 | 3 | 3 | 2 | 2 |
| 415 | 4 | 4 | 2 | 2 |

Figure 2:
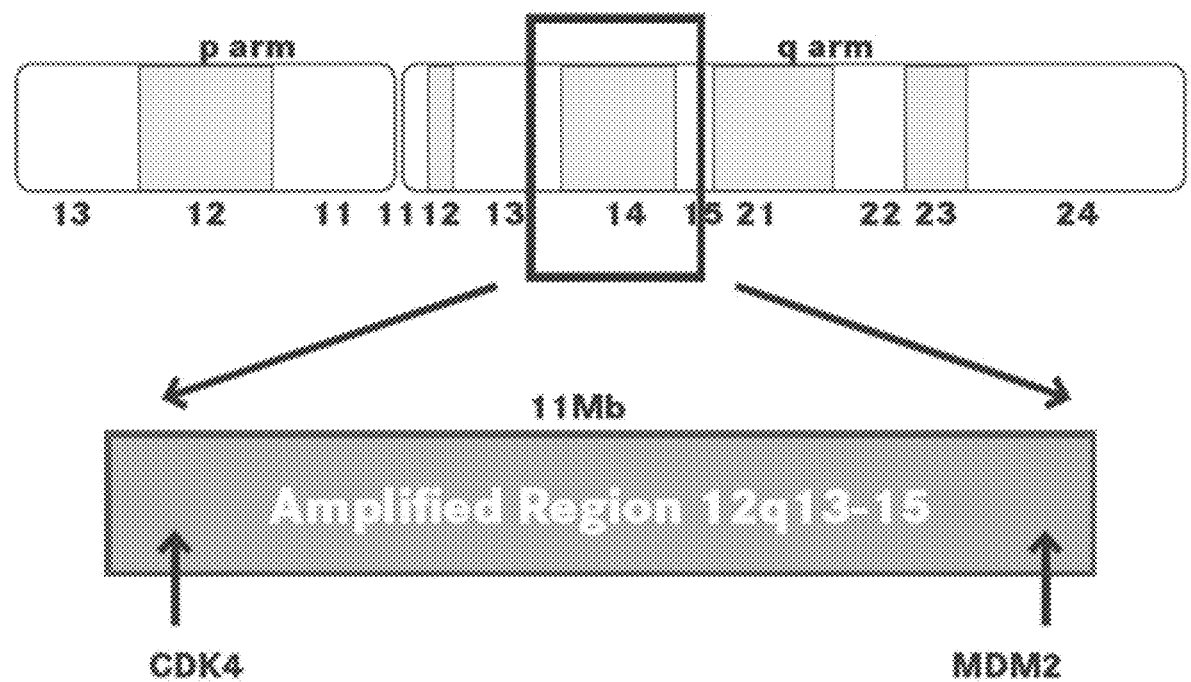
FIG. 2 shows that the p53 and Rb pathways are disabled by MDM2 or CDK4 gene amplification, which both reside on chromosome 12.

Example 16: Mechanism of Action p53 and Rb pathways trigger apoptosis, senescence, and cell growth arrest. FIG. 1 shows that AP1 and palbociclib trigger apoptosis, senescence, and cell growth arrest. The genes that encode MDM2 (a target of AP1) and CDK4 (a target of palbociclib) are co-localized on chromosome 12q and are often co-amplified. FIG. 2 shows that the p53 and Rb pathways are disabled by MDM2 or CDK4 gene amplification, which both reside on chromosome 12.

A genomic analysis confirmed amplification of MDM2 (45 copies) and CDK4 (50 copies) in the SJSA1 cell line. The amplification was consistent with high MDM2 and CDK4 protein expression. A genomic analysis of A549 and MCF7 cell lines showed CDKN2A deletion, with high MDMX protein expression levels. TABLE 10 shows the results of the genomic analyses of SJSA1, A549, and MCF7 cell lines.

TABLE 10

| Cell lines | p53 status | Array Comparative Genomic Hybridization | | NGS | | |
|---|---|---|---|---|---|---|
| | | MDM2 | CDK4 | MDM2 | MDMX | CDKN2A |
| SJSA-1 Sarcoma | WT | 45 copies | 32 copies | 50 copies | 2 copies | 2 copies |
| A549 Lung | WT | 2 copies | 2 copies | 2 copies | 2 copies | 0 copies |
| MCF7 Breast | WT | 2 copies | 2 copies | 2 copies | 2 copies | 0 copies |

Example 17: Pharmacology

In vitro pharmacology results from AP1+CDK4/6i combinations showed additive to synergistic activity across multiple cancer cell lines, and pharmacodynamic biomarkers indicated on-mechanism activity. In vivo pharmacology results of breast (MCF7) and sarcoma (SJSA1) mouse xenograft models, mouse PK, and tolerability demonstrate the efficacy of combination treatment with AP1 and a CDK4/6 inhibitor.

In vitro biochemical assays, x-ray crystallography and ligand displacement studies confirmed the binding of AP1 to target molecules MDM2/MDMX. On-target activation of p53-mediated pathways of apoptosis and cell cycle arrest were demonstrated in cancer cells at sub-micromolar concentrations. The ability of AP1 to induce cell cycle arrest and apoptotic cell killing was dependent on the presence of WT p53 protein. Proliferation and survival of cell lines with WT p53 protein was sensitive to AP1, with $IC_{50}$ values ranging from 0.2 to 3.3 µM. In SJSA-1 osteosarcoma cells, the functional consequences of binding of AP1 to the p53-regulatory site on MDM2 and MDMX included a concentration-dependent increase in p21 protein, the downstream transcriptional target of p53 and mediator of cell cycle arrest and cellular senescence; and increases in cellular caspase activity, which was indicative of early apoptotic events.

AP1 did not exhibit cytotoxic activity in cells lacking a functional p53 signaling pathway. In RKO-E6 cells, in which p53 expression and signaling is suppressed by a stably-transfected human papilloma virus (HPV) E6 oncogene, AP1 at concentrations exceeding 30 µM was not cytotoxic. AP1 also did not affect cell viability in SW480 cells, a colorectal cancer cell line with mutated p53 that renders the pathway ineffective. With respect to hematologic cancers, eleven WT TP53 hematologic cancer cell lines (6 lymphoma and 5 leukemia) were evaluated, which were highly sensitive to AP1 intervention and all exhibited $EC_{50}$ values less than 0.6 µM. These data demonstrate the effectiveness of AP1 against both solid and liquid tumor cell lines across multiple histological origins that retain the p53 WT status.

Figure 3:
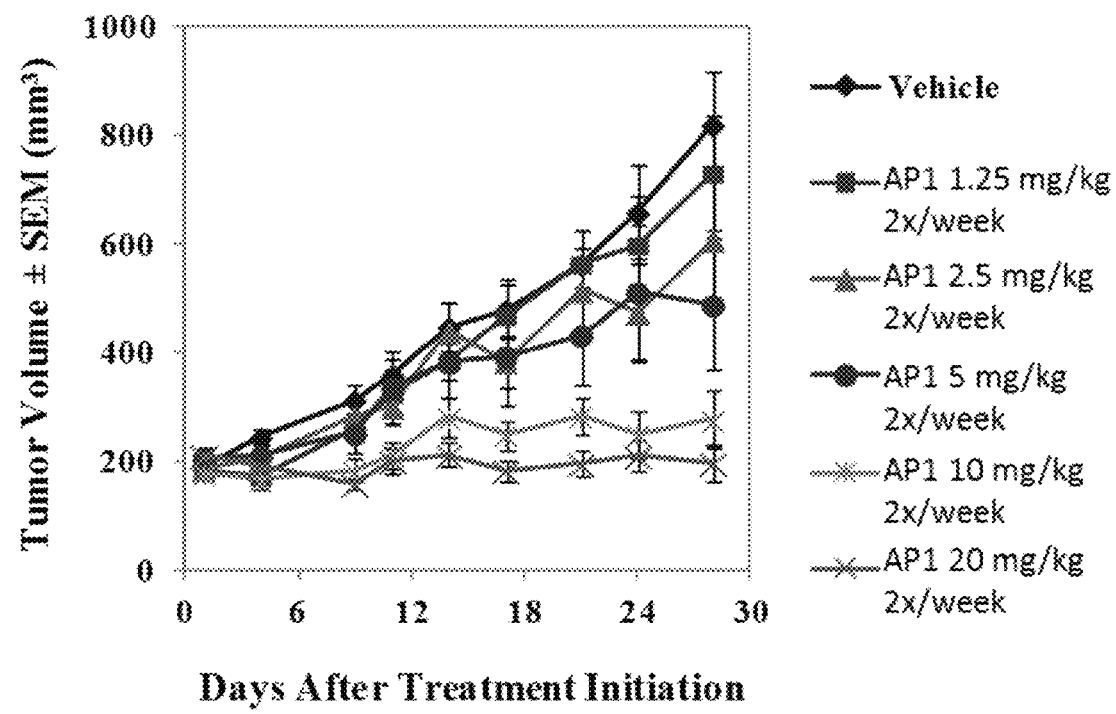
FIG. 3 shows that twice-weekly treatment with AP1 produced a dose-dependent TGI, with a minimum efficacious dose (MED) of 5 mg/kg, in the MCF7 breast cancer xenograft model.

The effect of AP1 on tumor growth was evaluated in murine xenograft models of human tumors, including human osteosarcoma, breast cancer, and melanoma models. Statistically significant tumor growth inhibition (TGI) was observed in each model following IV dosages, and TGI was found to be dose-related in all studies in which a range of dose levels was administered. AP1 exhibited consistent efficacy in mice implanted with WT TP53 human tumors that over-express MDM2 (e.g., SJSA-1 osteosarcoma xenograft model) or MDMX (e.g., MCF7 breast cancer xenograft model). For example, twice-weekly treatment with AP1 produced a dose-dependent TGI, with a minimum efficacious dose (MED) of 5 mg/kg, in the MCF7 breast cancer xenograft model (FIG. 3). In vivo PD assays also demonstrated that AP1 re-activated the p53 pathway, which was shown by decreased tumor cell proliferation, increased p53 protein, increased p21 (a downstream transcriptional target of p53), and increased apoptosis as indicated by an increase in cleaved poly-ADP-ribose polymerase (PARP).

Example 18: Toxicology and Nonclinical Safety

The 4-week multiple-dose GLP study of AP1 in rats and monkeys was conducted, which utilized twice-weekly IV dosing rather than the once-weekly IV dosing. The studies provided dose- and exposure-related assessments during both dosing and recovery periods, and the results were analyzed to define the maximum tolerated doses (MTD) and estimate the severely toxic dose for 10% ($STD_{10}$) of rats and the highest non-severely toxic dose (HNSTD) in monkeys. All gross and microscopic signs of intolerance (e.g., reduced organ weights, sporadic findings of multi-tissue hemorrhage and hepatic necrosis) and changes in serum chemistry parameters were considered as secondary to red blood cell (RBC), platelet and/or white blood cell (WBC) depletions, or anorexia and dehydration in both species. Recovery assessments revealed regenerative and compensatory changes that were consistent with marrow cell survival and reversibility of all related hematologic and secondary toxicities.

Figure 4:
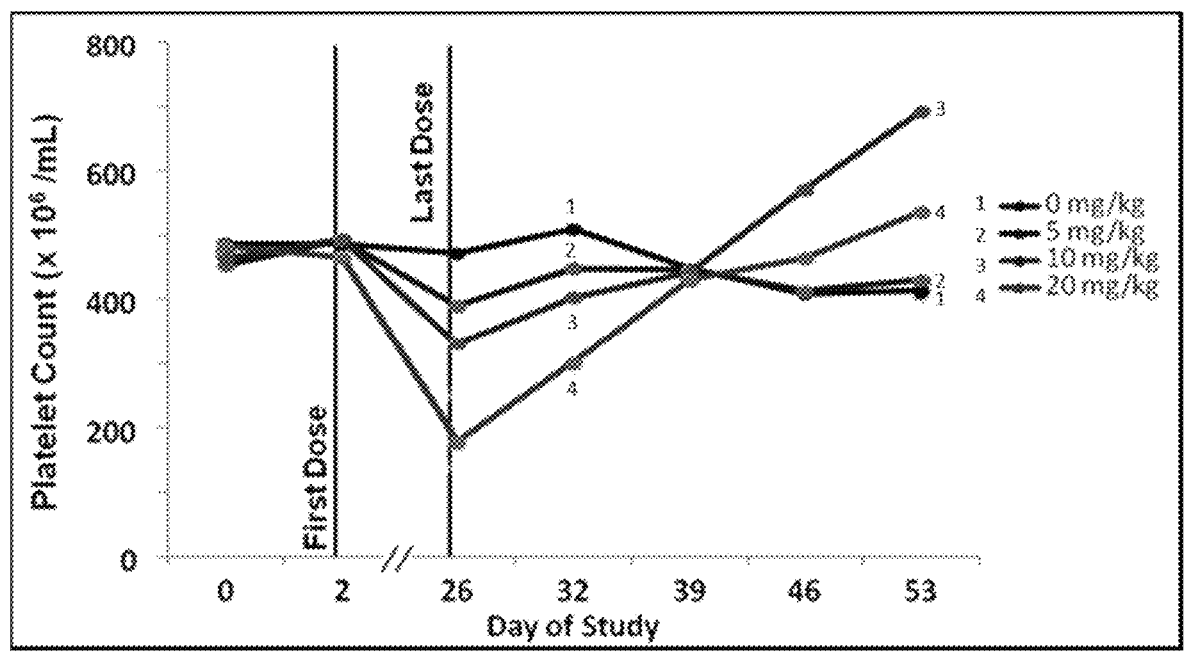
FIG. 4 shows a significant decrease in peripheral blood platelets after treatment with varying doses of AP1, which decrease recovered upon cessation of AP1 dosing in a 4-week monkey GLP toxicity study. Female results are shown as representative data.

The DLTs in both animal species were related to the suppression of hematopoietic cells in the bone marrow, in particular cells of the megakaryocyte lineage, resulting in significant decreases in peripheral blood platelets that demonstrated recovery upon the cessation of dosing. FIG. 4 shows a significant decrease in peripheral blood platelets after treatment with varying doses of AP1, which decrease recovered upon cessation of AP1 dosing in a 4-week monkey GLP toxicity study. Female results are shown as representative data.

The severely toxic dose in 10% of the animals ($STD_{10}$) in rats was defined at 10 mg/kg based on the mortality of one animal in a satellite group for hematology sampling during recovery. The highest non-severely toxic dose (HNSTD) in monkeys was defined at 5 mg/kg, based on a complete lack of significant thrombocytopenia at this lowest dose level. However, almost all of the monkeys at the mid- and high-dose levels tolerated AP1 administration well. Only one animal at each of these dose levels developed significant thrombocytopenia ($<100,000 \times 10^6$/ml).

Rats were more sensitive to the bone marrow and hematologic effects of AP1 than monkeys on the basis of exposures at maximally tolerated doses. Exposure at rat $STD_{10}$ ($AUC_{0-\infty}$=562 µg·hr/mL at 10 mg/kg) was below that of HNSTD in monkeys ($AUC_{0-\infty}$=813 µg·hr/mL at 5 mg/kg). The in vivo results correlated with those obtained from in vitro hemotoxicity assays using luminescence output (Halo®). AP1 in general inhibited the induced proliferation of bone marrow precursor cells from rats to a greater extent than those from monkeys or humans. $IC_{50}$ values were ~2- to 8-fold higher for rat cells than for monkey or human cells, with the largest difference noted for megakaryocyte colony forming cells (the platelet precursors). The results correlated with in vivo findings indicating that rats were more sensitive to the bone marrow and hematologic effects of AP1 than monkeys on the basis of dose and exposures at maximally tolerated doses. In terms of projecting potential bone marrow and hematological toxicity levels in humans, the monkey PK-PD data were more clinically relevant than the rat data.

AP1 was negative in genetic toxicology studies, including bacterial mutagenicity (Ames), chromosomal aberrations (human peripheral blood lymphocyte) and in vivo micronucleus (rat bone marrow) assays. Safety pharmacology studies were performed to assess the effects of AP on hERG potassium channels in vitro and on cardiac function in cynomolgus monkeys. No significant adverse findings in the studies.

Compared to the twice-weekly IV dosing schedule utilized in the 4-week GLP toxicity studies, the first-in-human clinical trial of AP1 initially assesses once-weekly IV dosing for three weeks. In addition, the demonstrated reversibility of AP1-induced hematologic effects, the ability to detect such findings with routine laboratory measurements, and the availability of effective supportive therapies, all provide additional safety margins in the clinic.

Example 19: Pharmacokinetics and Absorption, Distribution, Metabolism, and Excretion Pharmacokinetic studies (TABLE 11) characterized exposure kinetics following single IV administrations of AP1 in mice, rats, and monkeys, including evaluations of two different dosing formulations in rats and monkeys. Using qualified liquid chromatography with tandem mass spectrometry (LC-MS-MS) methods for efficacy models and dose range-finding (DRF) studies, and validated methods for GLP safety studies, exposure was characterized in mice at the MED in efficacy models and in rats and monkeys at tolerated and non-tolerated doses in toxicology studies. Exposures generally increased proportionally with dose, although an apparent plateau was observed at the highest dose of the 4-week monkey toxicology study. No sex-based differences were observed in either species, and no accumulation was observed following multiple doses.

TABLE 11

| Study Type | Description |
| --- | --- |
| Analytical Methods Development and Validation | Rat plasma |
| | Monkey plasma |
| | Human plasma |
| | In vitro dosing solutions |
| | In vivo dosing solutions |
| | Stability in rat whole blood |
| | Stability in monkey whole blood |
| | Method transfer report |
| Absorption/Kinetics | Single-dose mouse |
| | Single-dose rat |
| | Multi-dose rat |
| | Single-dose rat (2 formulations) |
| | Single-dose monkey (2 formulations) |
| Distribution | Plasma protein binding |
| | Conc.-dependent protein binding |
| | Substrate for hepatobiliary transporters |
| Metabolism | Multi-species hepatocytes |
| | Rat and monkey in vivo |
| Excretion | Rat bile and urine |
| PK Drug Interactions | CYP enzyme inhibition |
| | CYP enzyme induction |
| | Hepatic transporter inhibition |

The in vitro protein binding of AP1 was evaluated over a range of concentrations in mouse, rat and monkey plasma, as well as human plasma samples from normal subjects and hypoalbuminemic patients. Protein binding ranged from 92% to 98% in plasma of mice, rats, dogs, monkeys, and humans following incubation of AP1 at a single concentration of 2 µM, and exceeded 98% in mouse and rat plasma up to 250 µM. In human and monkey plasma, free AP1 fractions of 3-4% were measured at AP1 concentrations up to 150 µM, corresponding to expected $C_{max}$ values from clinical doses of up to 15 mg/kg, and rising to 12-14% at concentrations >200 µM. In plasma obtained from hypoalbuminemic patients, a similar rise was observed at >100 µM of AP i, corresponding to expected $C_{max}$ values from clinical doses of up to 10 mg/kg. The concentration-dependent plasma protein binding provided a possible explanation for the apparent plateau in exposure observed at the high-dose group (20 mg/kg) in the 4-week monkey GLP toxicity study, suggesting that less-than-dose-proportional exposure was possible at very high clinical doses, especially for patients with hypoalbuminemia.

In vitro studies demonstrated a similar metabolite profile across species, including humans, providing support for using data from the rat and monkey toxicology studies. Proteolysis is the major biotransformation pathway of AP1. The predominant metabolite of AP1, AP m, is a 3-amino acid truncation with the cyclic peptide portion intact. The same metabolite profile was noted in in vitro stability studies with mouse, rat, monkey, and human cryopreserved hepatocytes. In a single-dose rat study, hepatobiliary metabolism and elimination represented the predominant clearance pathway for AP1, and $AP1_m$ was the major excretion product observed in the bile. $AP1_m$ was also observed in plasma samples collected during the rat and monkey 4-week GLP toxicology studies. Adequate exposures in the rat and monkey studies provided characterization of exposure on the overall safety profile of AP1. In monkeys, $AP1_m$ plasma exposure was 10% of the AP1 AUC; in rats, $AP1_m$ exposure was 6% of the AP1 AUC. Accumulation of $AP1_m$ was not observed with repeated twice-weekly dosing in rats or monkeys. Inhibition or induction of cytochrome P450 (CYP) enzymes by AP1 was negligible at clinically-relevant concentrations.

Figure 5:
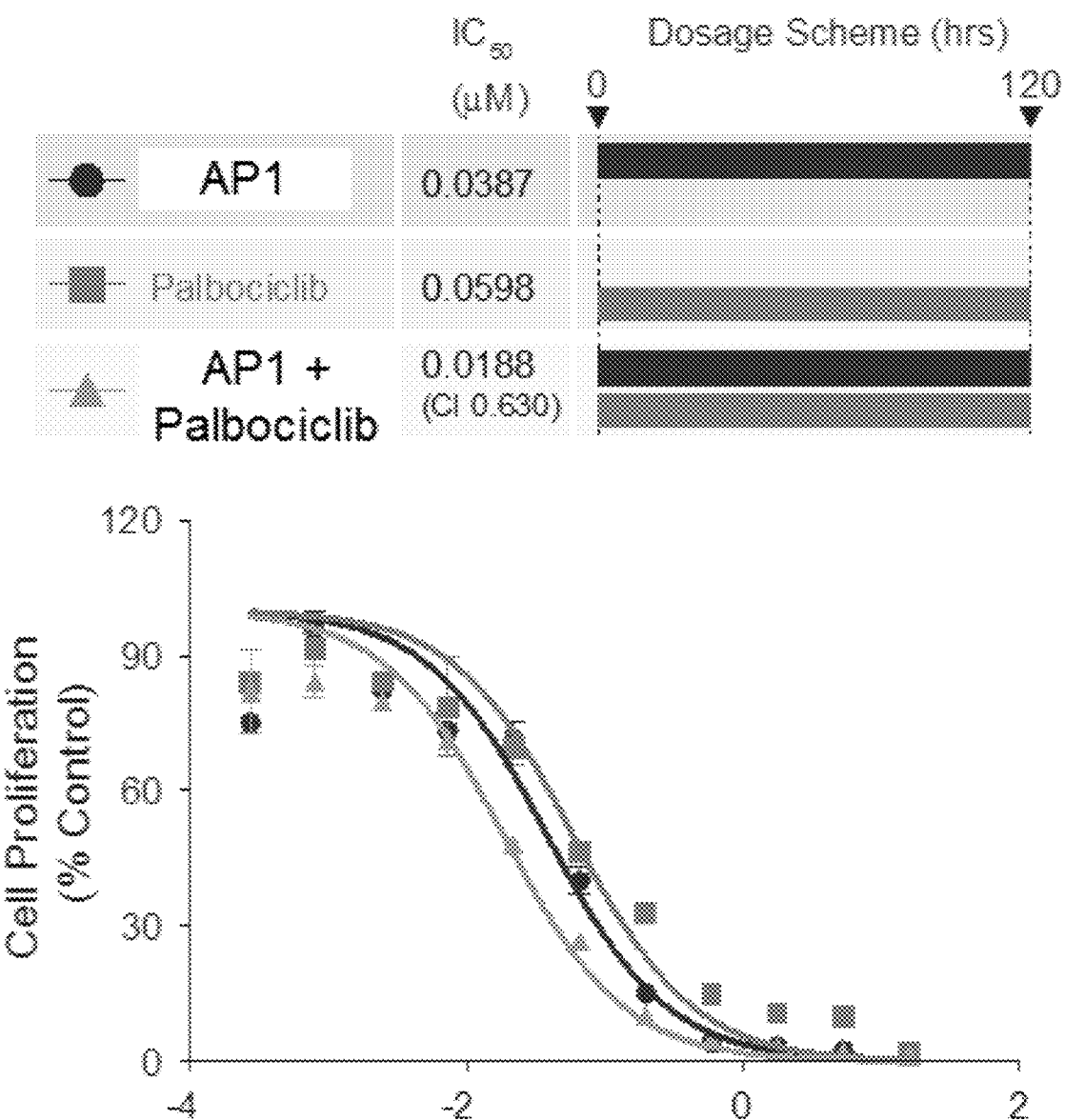
FIG. 5 shows that treatment of SJSA1 osteosarcoma cancer cells for 120 hr with AP1 alone inhibited cellular proliferation with an $IC_{50}$ value of 0.04 µM and treatment with palbociclib alone yielded an $IC_{50}$ of 0.06 µM.
Figure 6:
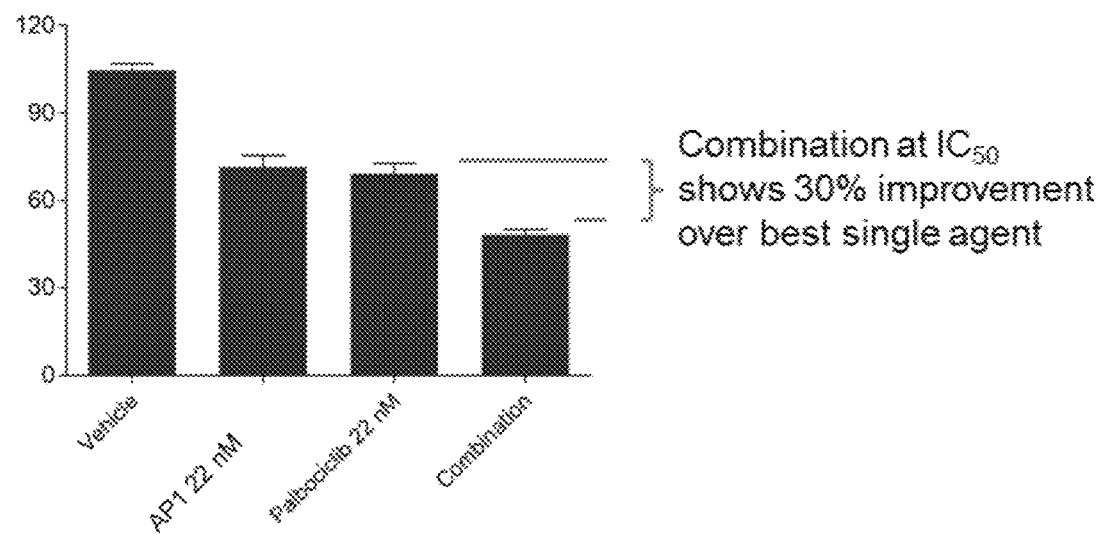
FIG. 6 shows that the combination of AP1 and palbociclib resulted in a 30% improvement over the best single agent.
Figure 7:
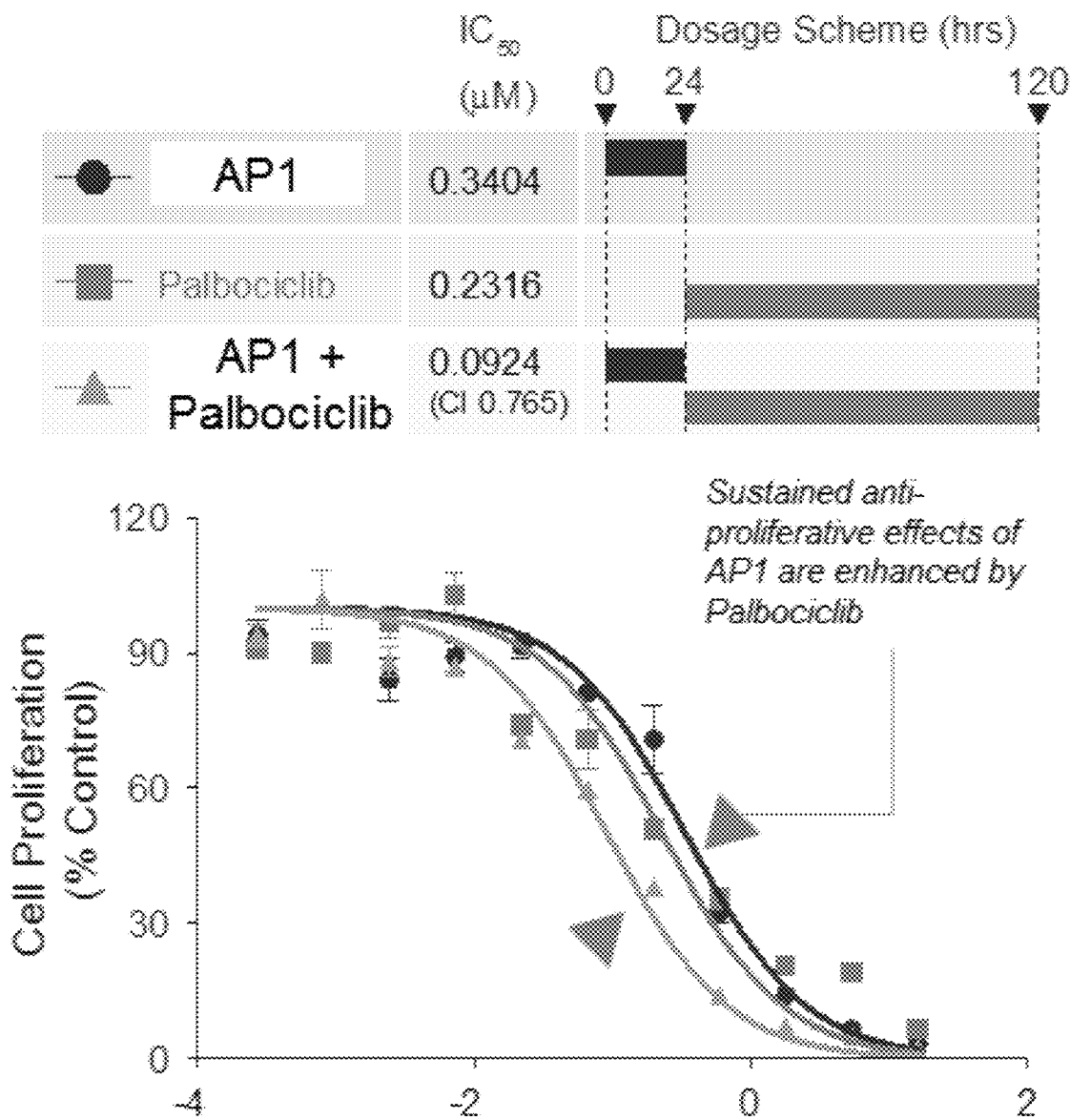
FIG. 7 shows that combination treatment with AP1 and palbociclib was effective against SJSA1 cancer cells when AP1 was administered first for 24 hours, followed by washout, and subsequent treatment with palbociclib for 96 hours.
Figure 8:
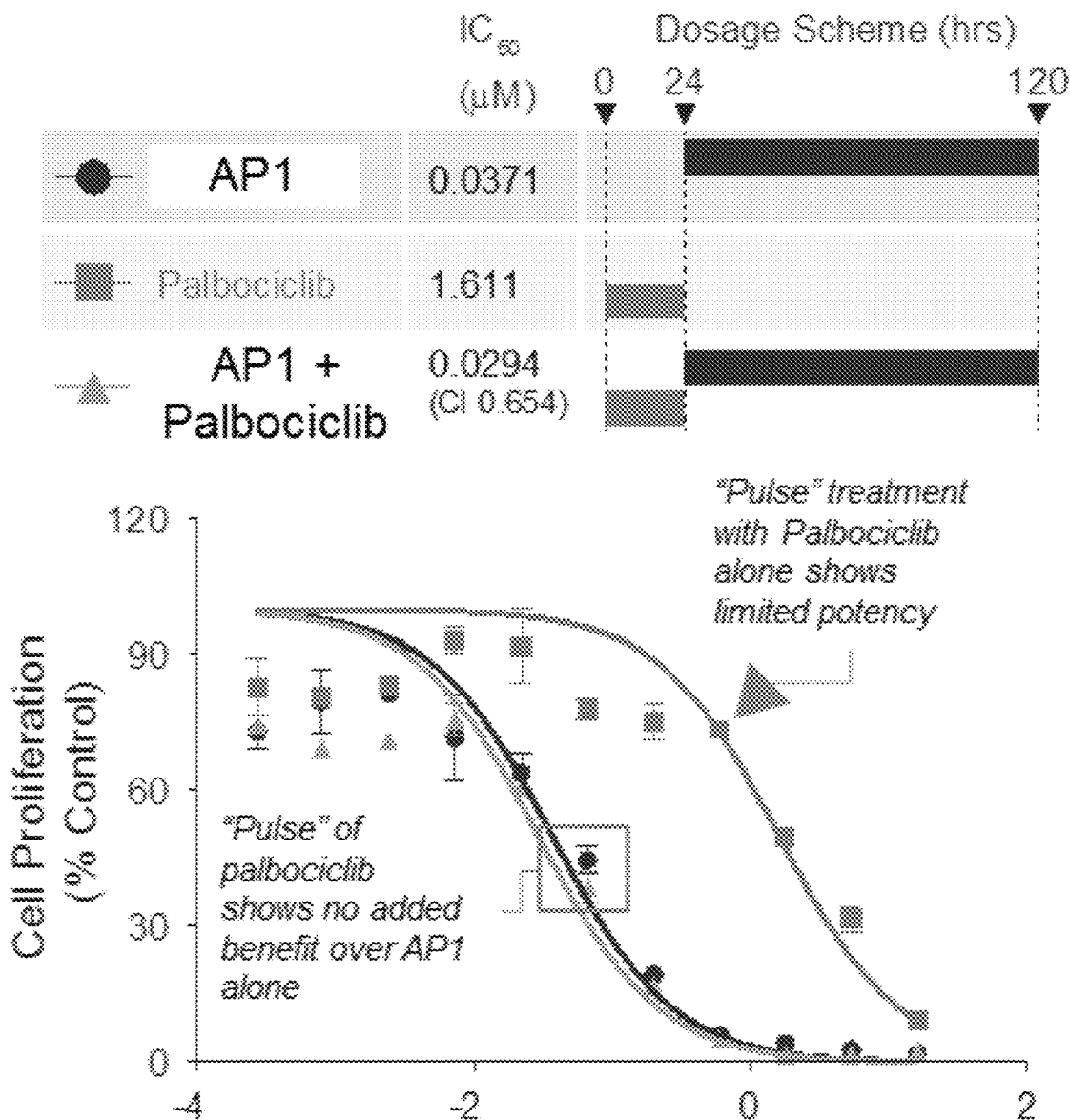
FIG. 8 shows that the combination treatment of AP1 and palbociclib was effective against SJSA1 cancer cells when palbociclib was administered first for 24 hours, followed by washout, and subsequent treatment with AP1 for 96 hours.

Example 20: Pharmacology of AP1 Administered in Combination with Palbociclib p53 plays a central role in a variety of signal transduction pathways, including cell cycle, senescence and apoptosis, which are critical to the treatment of cancer. Thus, reactivation of p53 by AP1 can play an important role in combination therapy to provide a greater anti-tumor response than single-agent treatment and minimize resistance to individual drugs. Combination treatment with AP1 and palbociclib resulted in synergistic in vitro anti-proliferative activity in SJSA1 cells. For example, the anticancer activity of the CDK4/6 inhibitor palbociclib was enhanced by combining with AP1 in an in vitro study. FIG. 5 shows that treatment of SJSA1 osteosarcoma cancer cells for 120 hr with AP1 alone inhibited cellular proliferation with an $IC_{50}$ value of 0.04 µM and treatment with palbociclib alone yielded an $IC_{50}$ of 0.06 µM. However, combination treatment with increasing concentrations of AP1 and palbociclib in a 1:1 ratio resulted in an improved $IC_{50}$ of 0.02 µM, suggesting additive to synergistic effects that were complementarity of the two anticancer agents when dosed together. FIG. 6 shows that the combination of AP1 and palbociclib resulted in a 30% improvement over the best single agent. FIG. 7 shows that combination treatment with AP1 and palbociclib was effective against SJSA1 cancer cells when AP1 was administered first for 24 hours, followed by washout, and subsequent treatment with palbociclib for 96 hours. This result suggests that the sustained anti-proliferative effects of AP1 were enhanced by palbociclib. FIG. 8 shows that the combination treatment of AP1 and palbociclib was effective against SJSA1 cancer cells when palbociclib was administered first for 24 hours, followed by washout, and subsequent treatment with AP1 for 96 hours. However, a short 24 hour pulse treatment with palbociclib alone resulted in limited potency.

Figure 9:
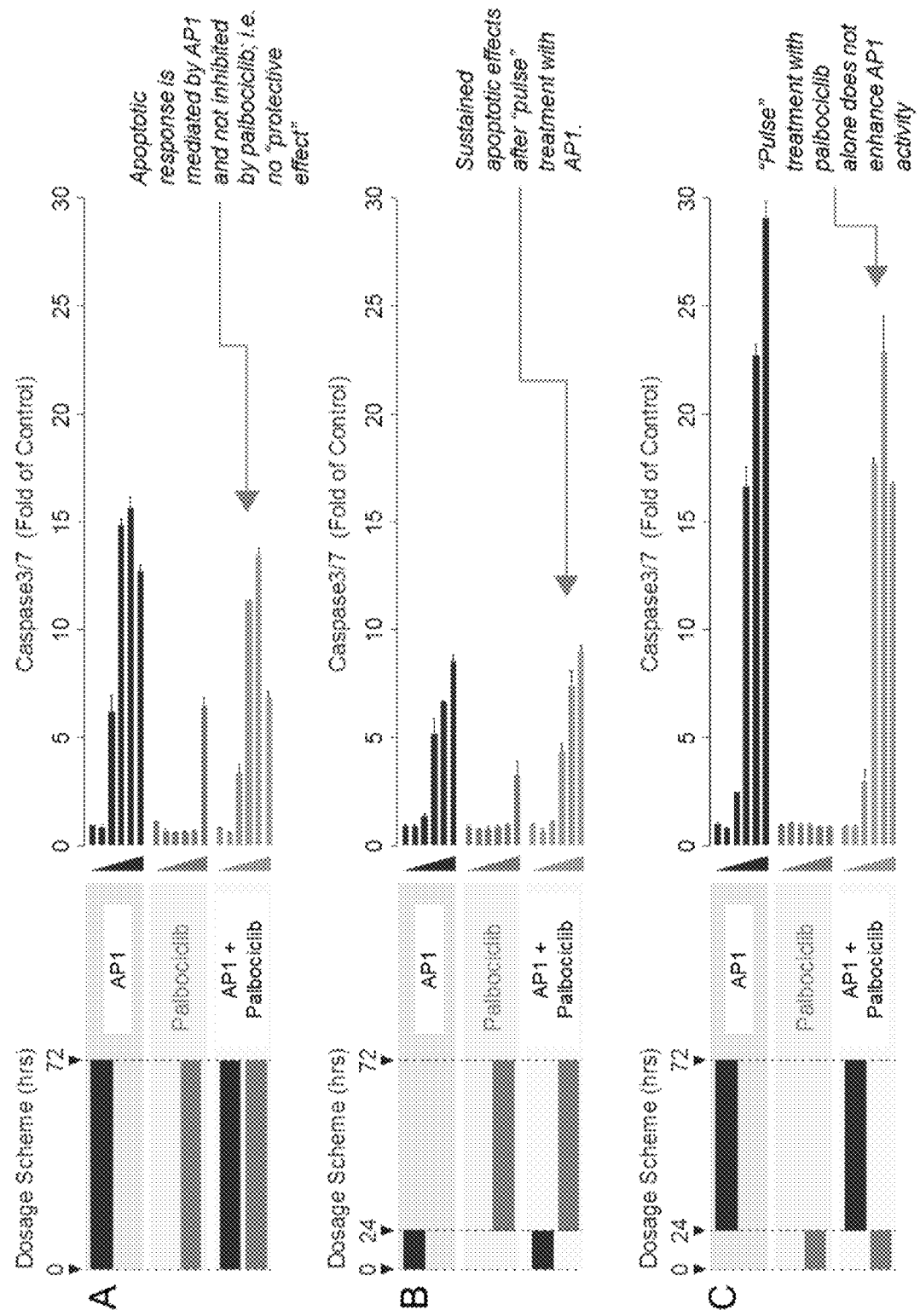
FIG. 9 PANEL A shows that caspase activation (a measure of apoptosis induction) was evident when AP1 and palbociclib were dosed simultaneously in SJSA1 cancer cells.

The mechanism underlying the enhancement of AP1's anti-proliferative effects when combined with palbociclib was investigated by measuring cell cycle arrest, apoptosis, and the up- and down-regulation of specific molecular markers in cancer cells in vitro following single-agent treatment or combination treatment. Apoptosis assays showed synergistic cell killing by AP1+palbociclib combination treatment in SJSA1 cells. FIG. 9 PANEL A shows that caspase activation (a measure of apoptosis induction) was evident when AP1 and palbociclib were dosed simultaneously in SJSA1 cancer cells. FIG. 9 PANEL B shows that caspase was evident with sustained apoptotic effects after a 24 hour pulse treatment with AP1. FIG. 9 PANEL C shows that caspase activation was not evident from 24 hour pulse treatment with palbociclib alone or in combination with AP1.

Figure 10:
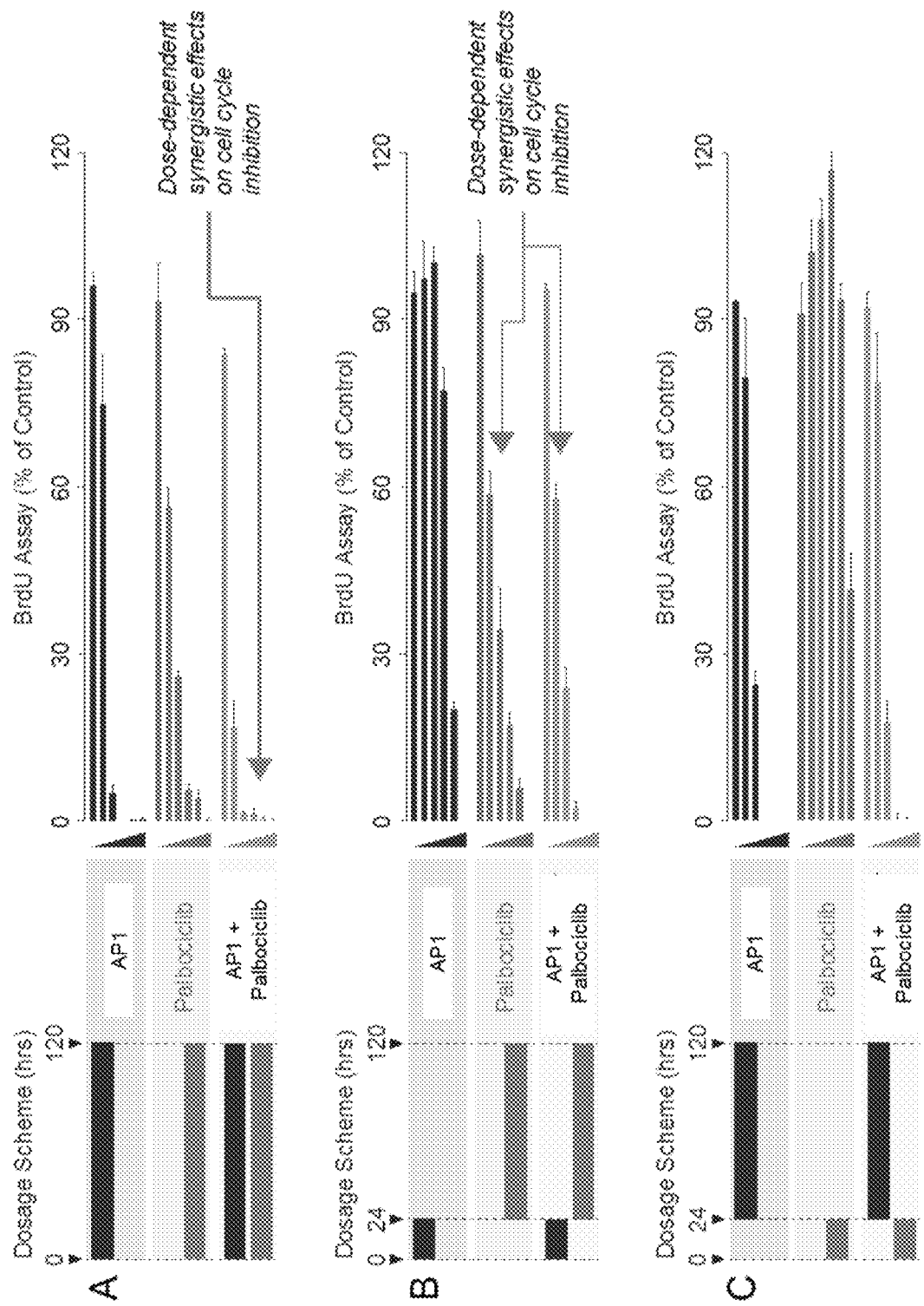
FIG. 10 PANEL A shows that the BrdU incorporation assay demonstrated dose-dependent synergistic effects when AP1 and palbociclib were dosed simultaneously in SJSA1 cells.

Bromodeoxyuridine (BrdU) incorporation into the DNA of SJSA1 cells was measured to evaluate cell cycle arrest. Results showed a decrease in cycling cells when the cells were treated with AP1+palbociclib. BrdU incorporation assays showed synergistic cell cycle inhibition by AP1 and palbociclib combination treatment in SJSA1 cells. FIG. 10 PANEL A shows that the BrdU incorporation assay demonstrated dose-dependent synergistic effects when AP1 and palbociclib were dosed simultaneously in SJSA1 cells. FIG. 10 PANEL B shows that the BrdU incorporation assay demonstrated dose-dependent synergistic effects when palbociclib was used for a 96 hour treatment course and when AP1 was used to treat the cells for 24 hours first and followed by a 96 hour treatment with palbociclib. FIG. 10 PANEL C shows that the BrdU incorporation assay did not demonstrate synergistic effects when palbociclib was used for a 24 hour pulse treatment alone or in combination with AP1.

Figure 11:
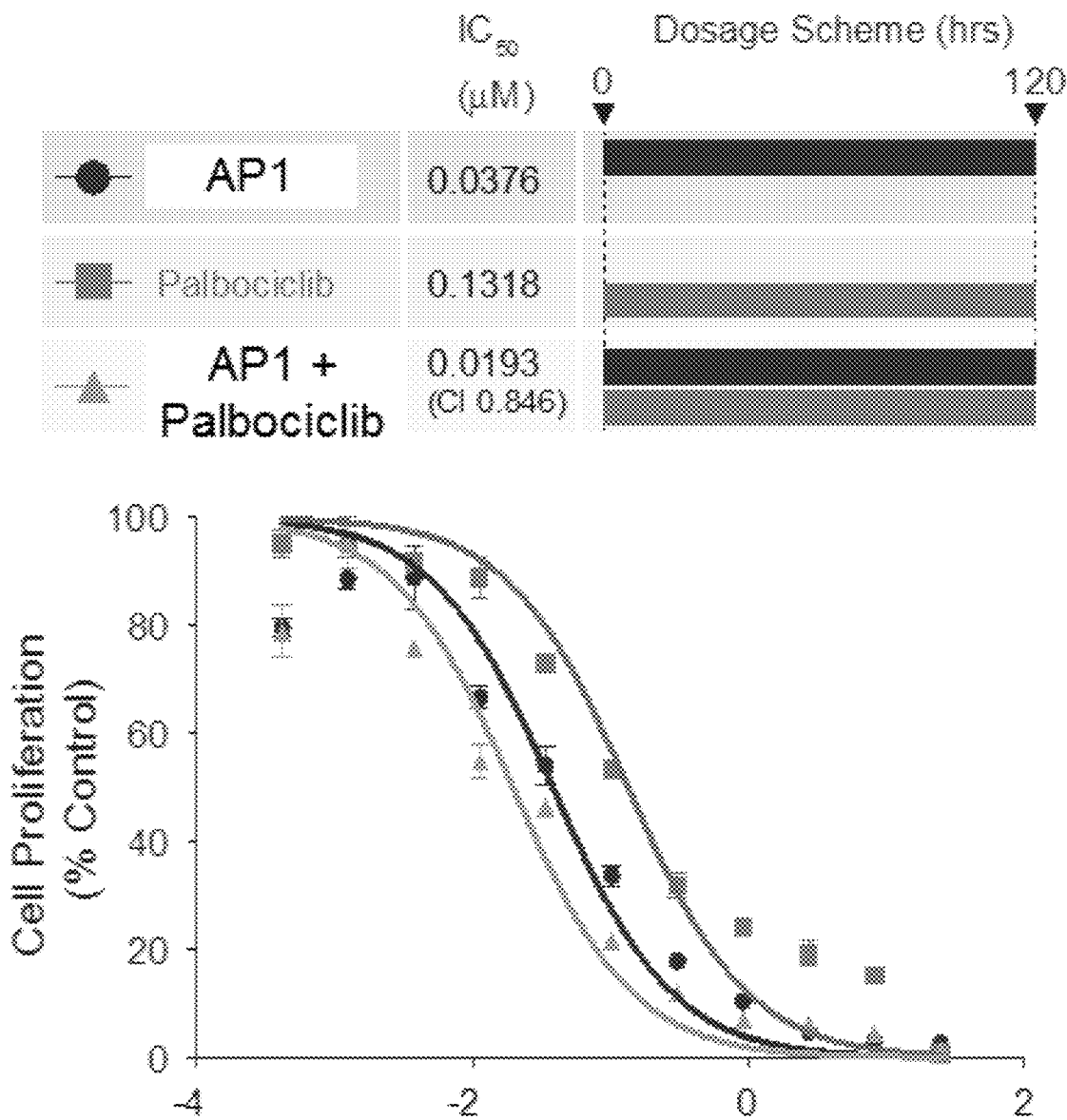
FIG. 11 shows that combination treatment with AP1 and palbociclib using simultaneous dosing exhibited synergistic effects in in vitro anti-proliferative activity in MCF7 cells.
Figure 12:
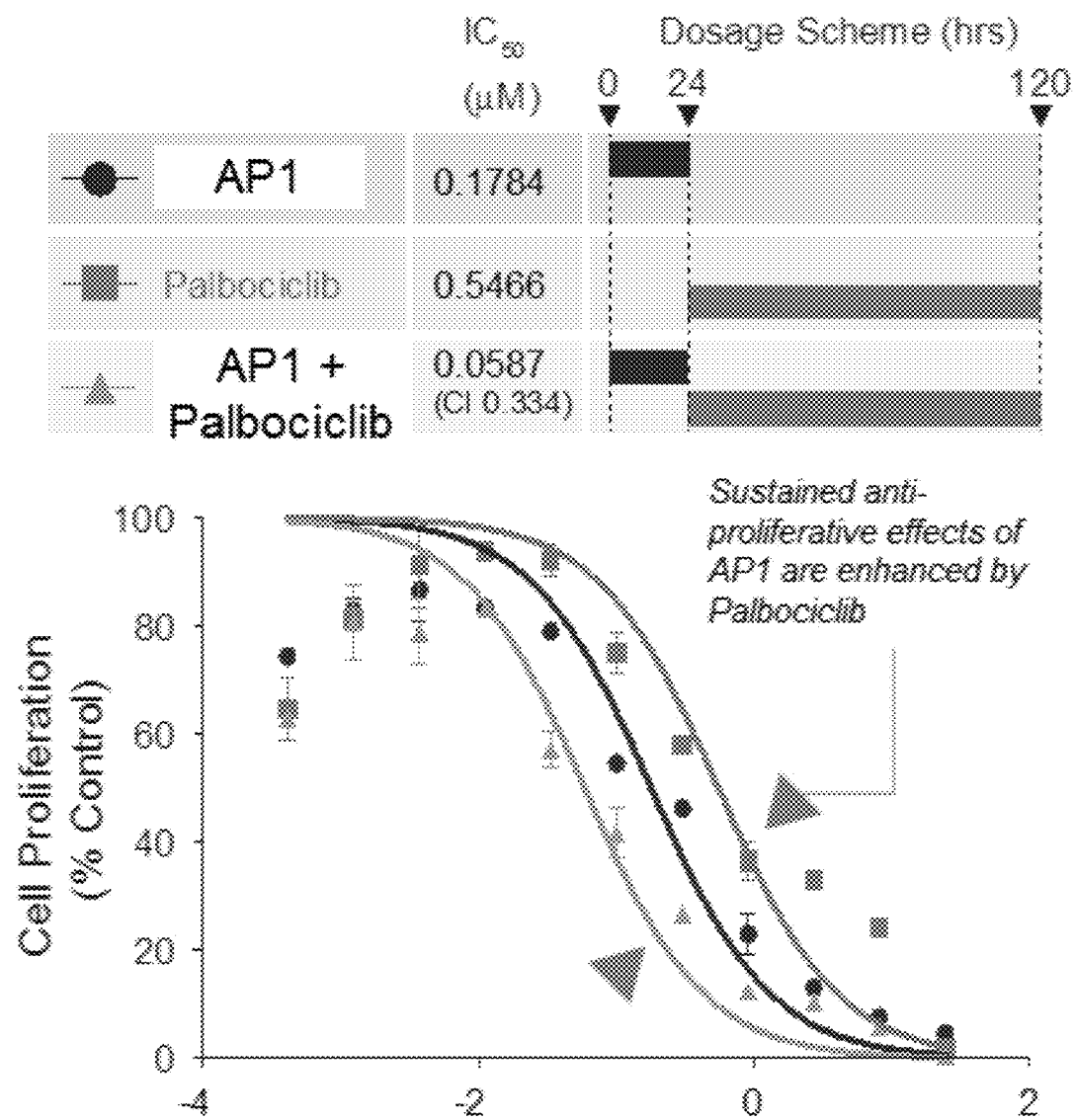
FIG. 12 shows that a 24 hour pulse treatment with AP1 and subsequent treatment with palbociclib resulted in sustained anti-proliferative effects in MCF7 cells.
Figure 13:
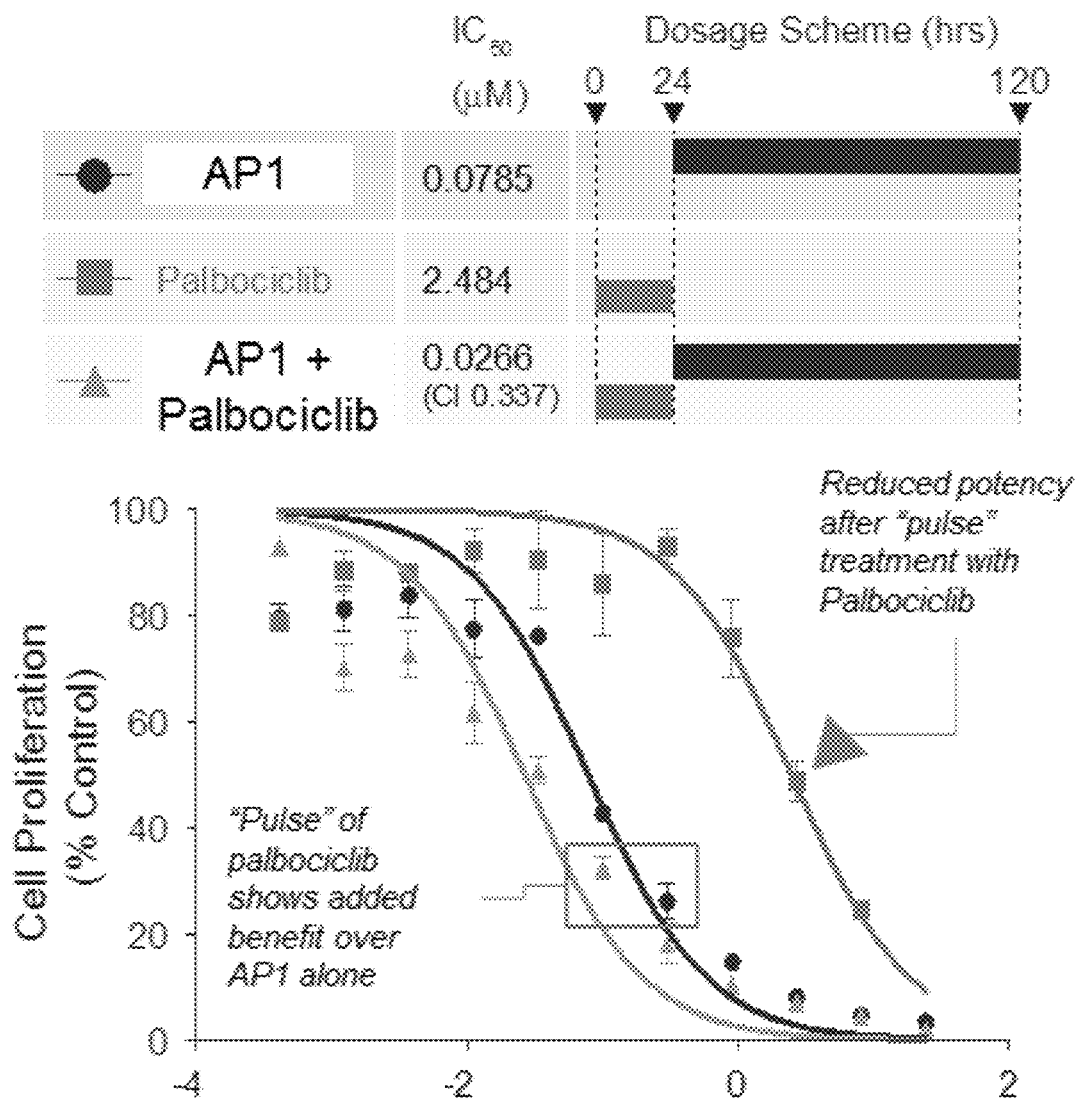
FIG. 13 shows that a 24 hour pulse treatment with palbociclib and subsequent treatment with AP1 resulted in an added benefit over treatment with AP1 or palbociclib alone.

AP1 in combination with palbociclib also displayed synergistic in vitro anti-proliferative activity in MCF7 cells. Synergy was observed upon concomitant exposure to AP1+ palbociclib, and 24 hour pulse treatments of AP1 followed by palbociclib. In contrast to palbociclib treatment of SJSA1 cells, a 24 hour pulse treatment of palbociclib in MCF7 cells demonstrated an added benefit over treatment with AP1 alone. FIG. 11 shows that combination treatment with AP1 and palbociclib using simultaneous dosing exhibited synergistic effects in in vitro anti-proliferative activity in MCF7 cells. FIG. 12 shows that a 24 hour pulse treatment with AP1 and subsequent treatment with palbociclib resulted in sustained anti-proliferative effects in MCF7 cells. FIG. 13 shows that a 24 hour pulse treatment with palbociclib and subsequent treatment with AP1 resulted in an added benefit over treatment with AP1 or palbociclib alone.

Figure 14:
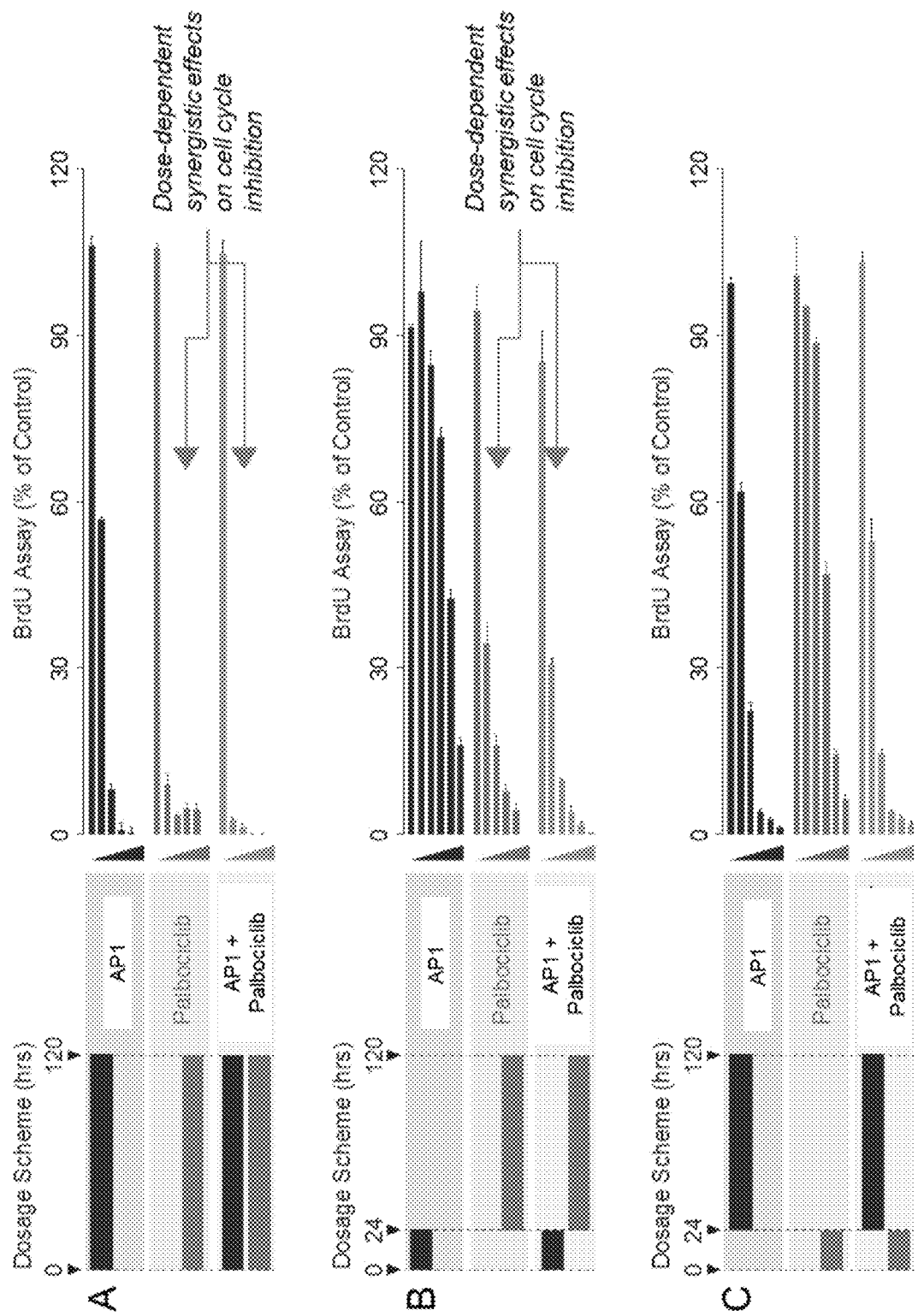
FIG. 14 PANEL A shows that combination treatment with AP1 and palbociclib at simultaneous dosing resulted in dose-dependent synergistic effects on cell cycle inhibition in MCF7 cells.

BrdU incorporation assays showed synergistic cell cycle inhibition by AP1 and palbociclib combination treatment in MCF7 cells. FIG. 14 PANEL A shows that combination treatment with AP1 and palbociclib at simultaneous dosing resulted in dose-dependent synergistic effects on cell cycle inhibition in MCF7 cells. FIG. 14 PANEL B shows that a 24 hour pulse treatment with AP1 and subsequent treatment with palbociclib resulted in dose-dependent synergistic effects on cell cycle inhibition in MCF7 cells compared to a 24 hour pulse treatment with AP1 alone or treatment with palbociclib alone. FIG. 14 PANEL C shows that a 24 hour pulse treatment with palbociclib and subsequent treatment with AP1 resulted in dose-dependent synergistic effects on cell cycle inhibition in MCF7 cells compared to a 24 hour pulse treatment with AP1 alone or treatment with palbociclib alone.

Figure 15:
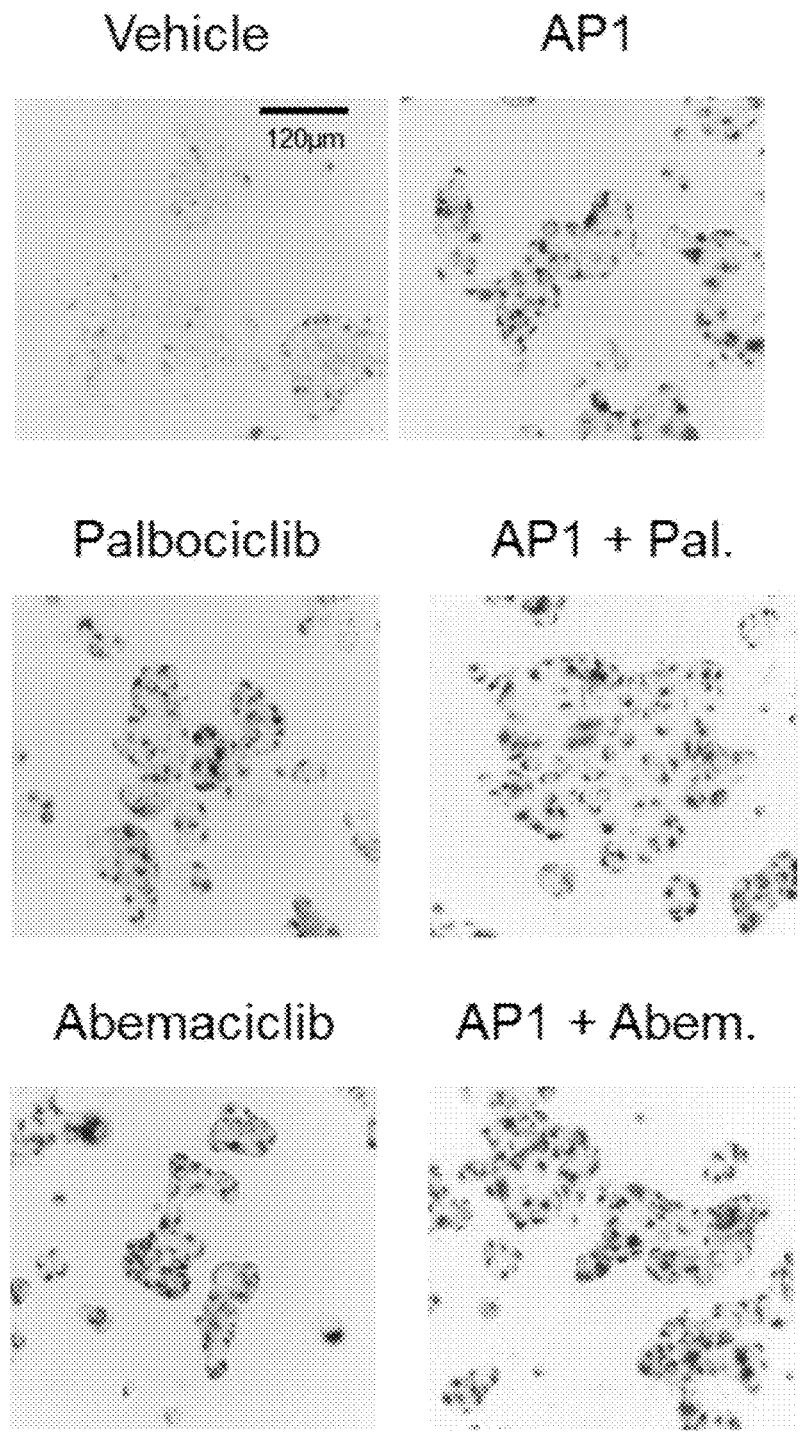
FIG. 15 shows that AP1 induced cellular senescence in MCF7 cells when used alone or in combination with palbociclib or abemaciclib.
Figure 16:
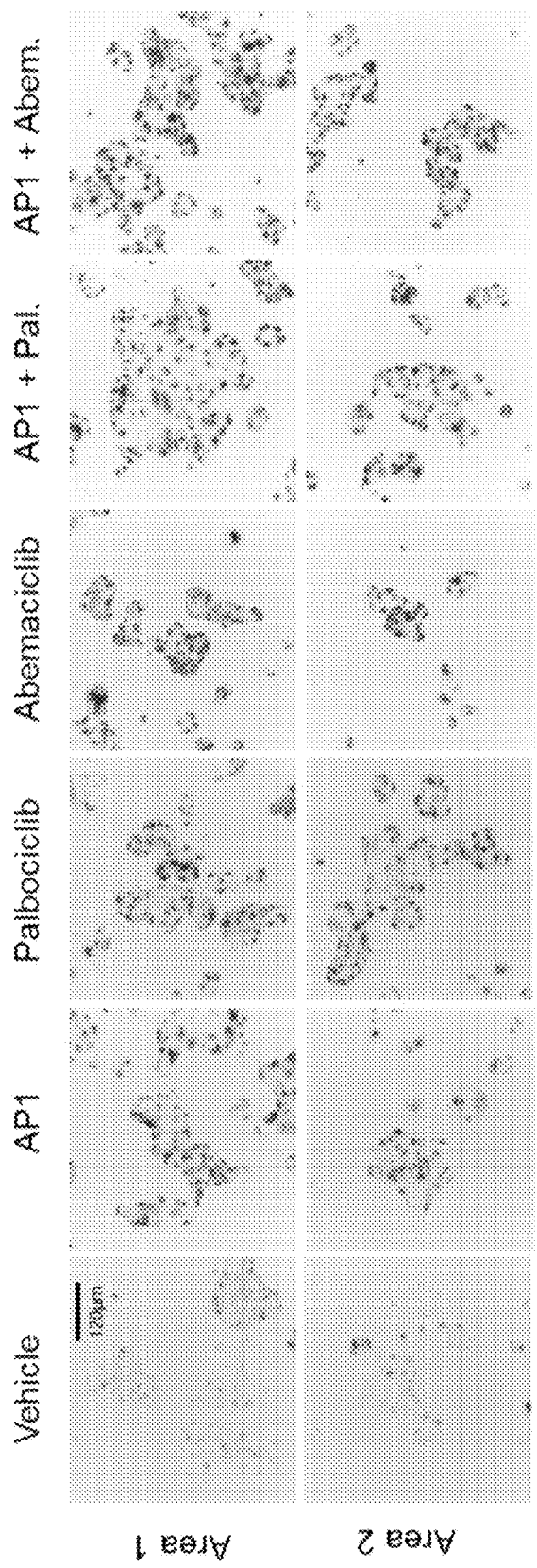
FIG. 16 shows that AP1 induced cellular senescence in MCF7 cells when used alone or in combination with palbociclib or abemaciclib.

AP1 induced cellular senescence in vitro as monotherapy and in combination with CDK4/6 inhibitors. MCF7 breast cancer cells were treated with palbociclib (0.3 µM), abemaciclib (0.3 µM), and AP1 (0.3 µM) alone or in combination with 7 days. The cells were then washed and visualized with β-galactosidase substrate X-gal. FIG. 15 and FIG. 16 show that AP1 induced cellular senescence in MCF7 cells when used alone or in combination with palbociclib or abemaciclib.

Figure 17:
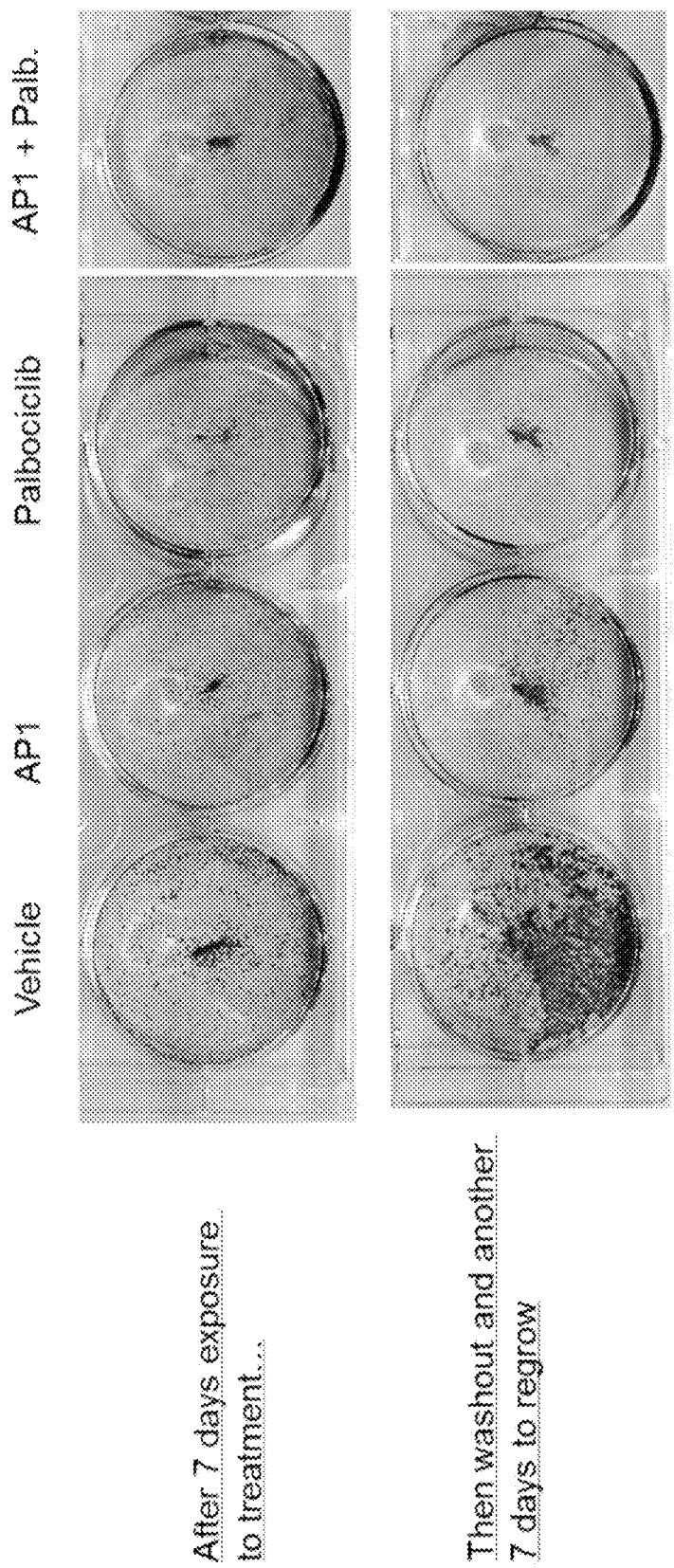
FIG. 17 TOP PANEL shows that cells treated with AP1 and palbociclib exhibited inhibition of cellular proliferation in MCF7 cells.
Figure 18:
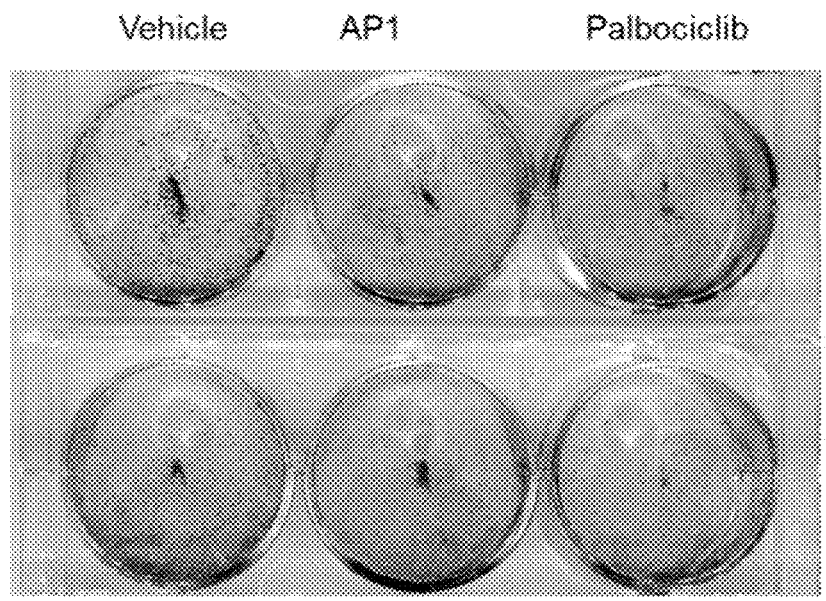
FIG. 18 PANEL A shows that MCF7 cells treated with AP1+ abemaciclib or AP1+palbociclib exhibited inhibition of cellular proliferation.
Figure 18:
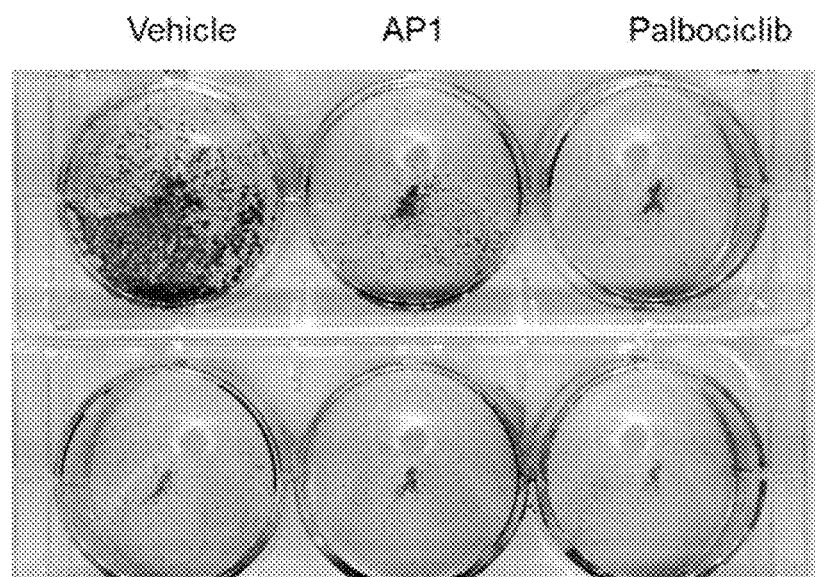

AP1 combination treatment with CDK4/6 inhibitors also showed sustained inhibition of cellular proliferation following wash-out. MCF7 breast cancer cells were treated with palbociclib (0.3 µM) and AP1 (0.3 µM) alone or in combination for seven days and then visualized using Giemsa staining. MCF7 breast cancer cells were also treated with palbociclib (0.3 µM) and AP1 (0.3 µM) alone or in combination for seven days, were washed, regrown for seven days, then visualized using Giemsa staining. FIG. 17 TOP PANEL shows that cells treated with AP1 and palbociclib exhibited inhibition of cellular proliferation in MCF7 cells. FIG. 17 BOTTOM PANEL shows that cells that were treated with AP1 and palbociclib, washed, and regrown exhibited sustained inhibition of cellular proliferation in MCF7 cells. FIG. 18 PANEL A shows that MCF7 cells treated with AP1+abemaciclib or AP1+palbociclib exhibited inhibition of cellular proliferation. FIG. 18 PANEL B shows that cells that were treated with AP1+abemaciclib or AP1+palbociclib, washed, and regrown exhibited sustained inhibition of cellular proliferation in MCF7 cells.

Figure 19:
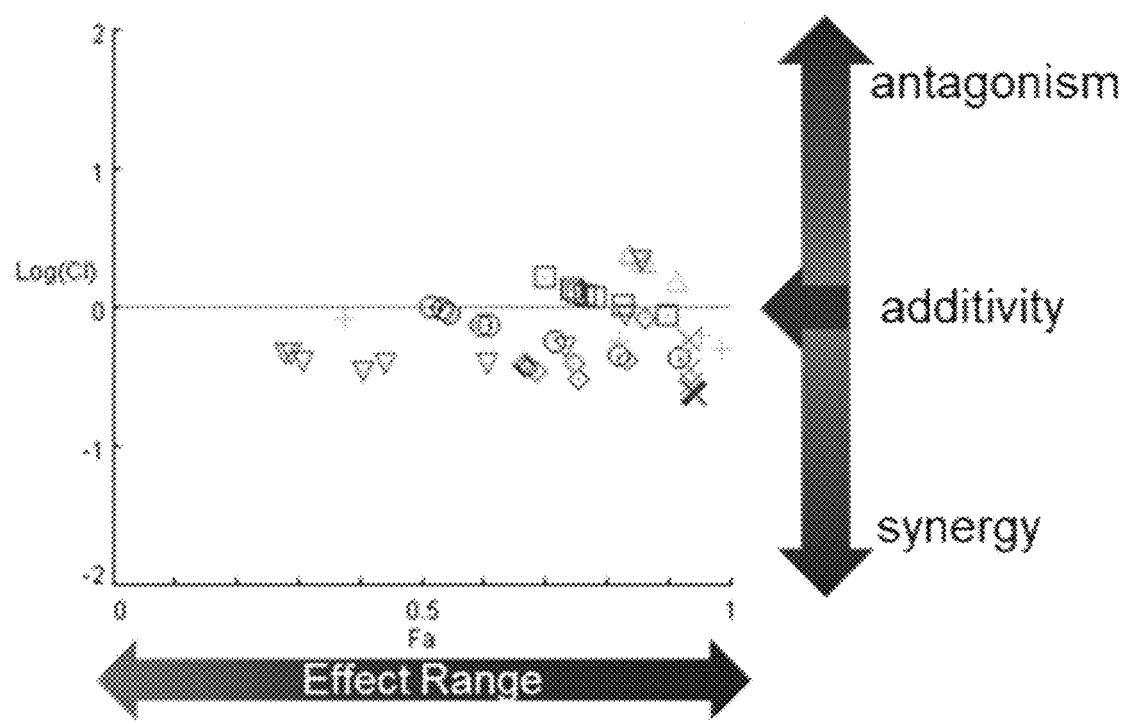
FIG. 19 shows the CI of the effects of combination treatment with AP1 and palbociclib on MCF7 cell proliferation.

The effect over highest single agent (EOHSA) and Chou-Talalay Combination Index (CI) showed that combination treatment with AP1 and palbociclib resulted in synergism. TABLE 12A-TABLE 12D show % inhibition of MCF7 cells resulting from combination treatment with AP1 and palbociclib. FIG. 19 shows the CI of the effects of combination treatment with AP1 and palbociclib on MCF7 cell proliferation.

TABLE 12A

| % inhibition | | AP1, µM | | | | | | | | | | |
|---|---|---|---|---|---|---|---|---|---|---|---|---|
| | | 30 | 10 | 3 | 1 | 0.3 | 0.1 | 0.03 | 0.01 | 0.003 | 0.001 | .0003 |
| Palbo, µM | 3.0 | 99.8 | 99.6 | 97.9 | 95.2 | 89.9 | 88.1 | 87.7 | 87.2 | 86.3 | 87.2 | 88.3 |
| | 1.0 | 99.8 | 99.6 | 97.5 | 94.1 | 87.2 | 84.2 | 80.5 | 79.0 | 79.7 | 79.7 | 82.8 |
| | 0.3 | 100.0 | 99.5 | 97.3 | 94.1 | 83.5 | 73.9 | 63.6 | 58.6 | 56.8 | 58.4 | 64.1 |
| | 0.0 | 100.0 | 99.6 | 97.3 | 93.7 | 62.3 | 25.0 | −9.1 | −7.3 | −19.2 | −2.2 | −18.1 |

TABLE 12B

| EOHSA | | AP1, µM | | | | | | | | | | |
|---|---|---|---|---|---|---|---|---|---|---|---|---|
| | | 30 | 10 | 3 | 1 | 0.3 | 0.1 | 0.03 | 0.01 | 0.003 | 0.001 | .0003 |
| Palbo, µM | 3.0 | −0.20 | 0.00 | 0.60 | 1.50 | 5.90 | 4.10 | 3.70 | 2.30 | 2.30 | 3.20 | 4.30 |
| | 1.0 | −0.20 | 0.00 | 0.20 | 0.40 | 8.30 | 5.30 | 1.60 | 0.10 | 0.80 | 0.80 | 3.90 |
| | 0.3 | 0.00 | −0.10 | 0.00 | 0.40 | 20.60 | 11.00 | 0.70 | −4.30 | −6.10 | −4.50 | 1.20 |
| | 0.0 | | | | | | | | | | | |

TABLE 12C

| % inhibition | | Palbociclib, µM | | | | | | | | | | |
|---|---|---|---|---|---|---|---|---|---|---|---|---|
| | | 30 | 10 | 3 | 1 | 0.3 | 0.1 | 0.03 | 0.01 | 0.003 | 0.001 | .0003 |
| AP1, µM | 1.0 | 100.0 | 94.0 | 93.4 | 93.0 | 93.2 | 93.5 | 93.7 | 94.1 | 93.5 | 93.7 | 94.0 |
| | 0.3 | 100.0 | 89.2 | 88.0 | 86.3 | 83.4 | 74.9 | 75.5 | 66.7 | 67.0 | 66.3 | 68.7 |
| | 0.1 | 100.0 | 85.8 | 85.6 | 83.1 | 73.3 | 60.7 | 44.0 | 40.4 | 28.7 | 27.7 | 30.8 |
| | 0.0 | 100.0 | 84.3 | 84.0 | 78.9 | 62.9 | 40.9 | 21.1 | 6.6 | −9.7 | −19.0 | −10.0 |

TABLE 12D

| EOHSA | | Palbociclib, µM | | | | | | | | | | |
|---|---|---|---|---|---|---|---|---|---|---|---|---|
| | | 30 | 10 | 3 | 1 | 0.3 | 0.1 | 0.03 | 0.01 | 0.003 | 0.001 | .0003 |
| API, µM | 1.0 | 0.00 | 0.32 | −0.40 | −0.70 | −0.50 | −0.20 | 0.00 | 0.40 | −0.20 | 0.00 | 0.30 |
| | 0.3 | 0.00 | 4.90 | 4.00 | 7.40 | 20.50 | 12.60 | 13.20 | 4.40 | 4.70 | 4.00 | 5.50 |
| | 0.1 | 0.00 | 1.50 | 1.60 | 4.20 | 10.40 | 19.80 | 19.00 | 15.40 | 3.70 | 2.70 | 5.80 |
| | 0.0 | | | | | | | | | | | |

Figure 20:
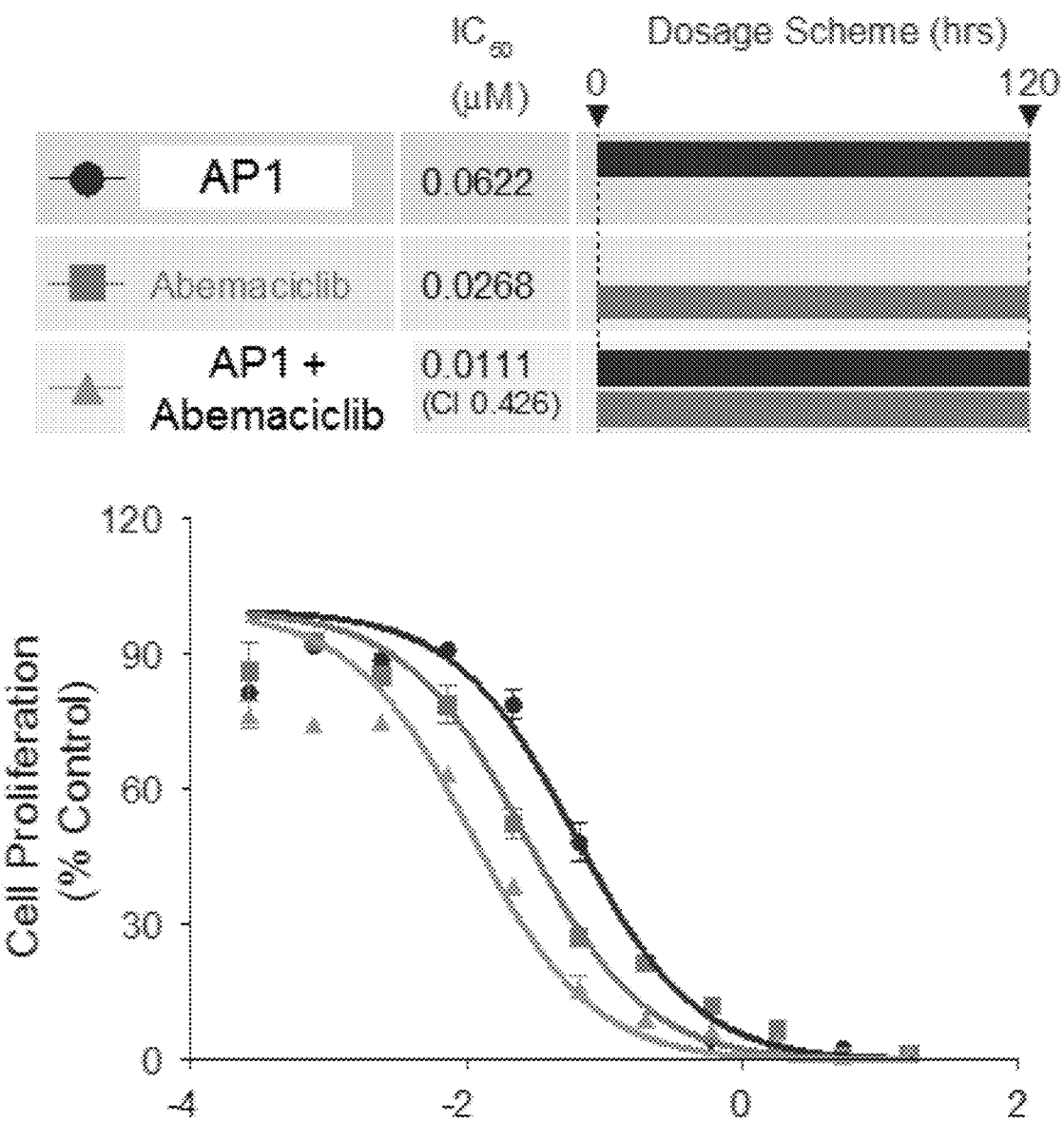
FIG. 20 shows that combination treatment with AP1 and abemaciclib displayed a synergistic effect in anti-proliferative activity in SJSA1 cells.
Figure 21:
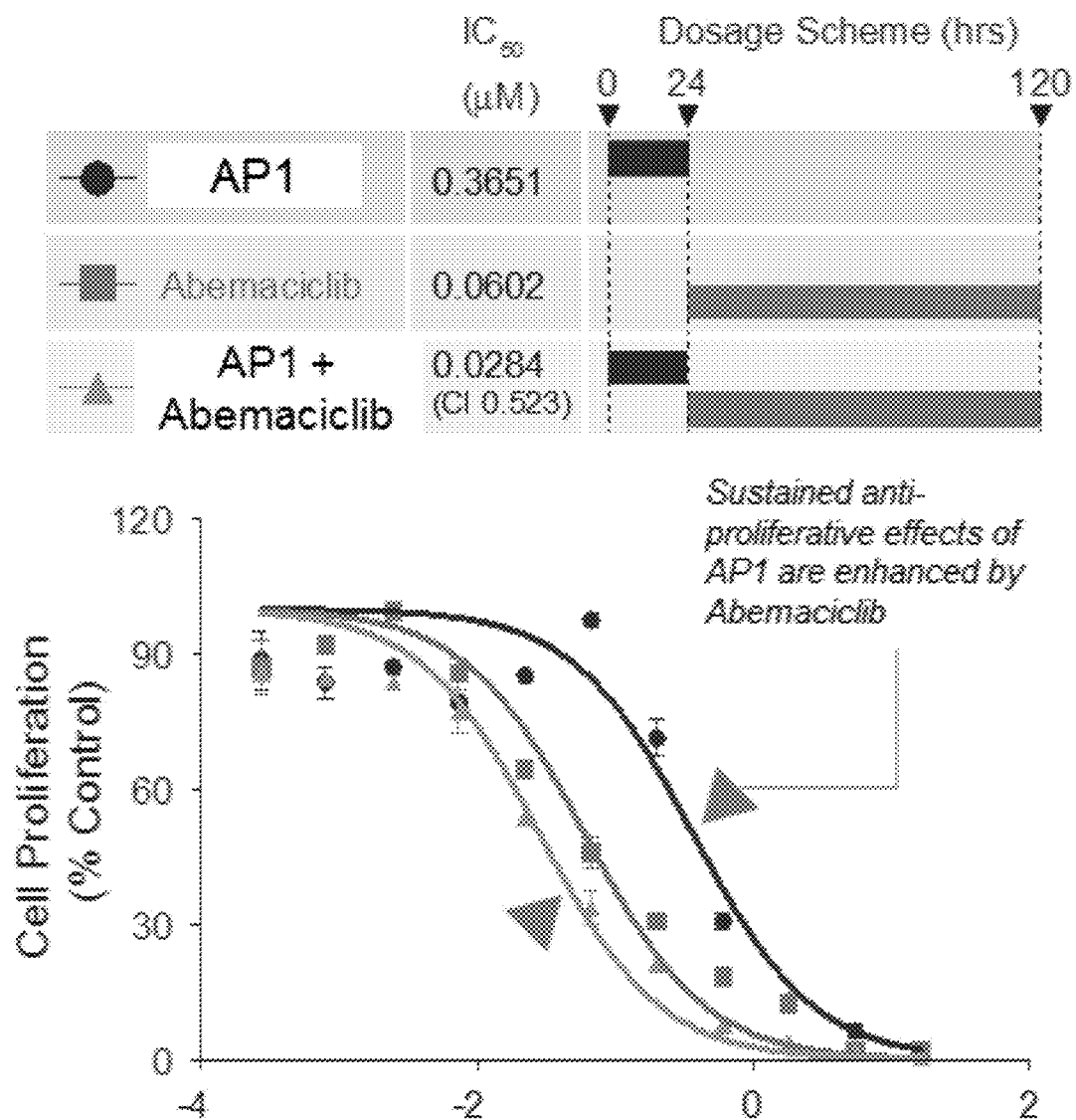
FIG. 21 shows that treating SJSA1 cells with a 24 hour pulse of AP1 followed by treatment with abemaciclib resulted in sustained anti-proliferative activity compared to treatment with AP1 or abemaciclib alone.
Figure 22:
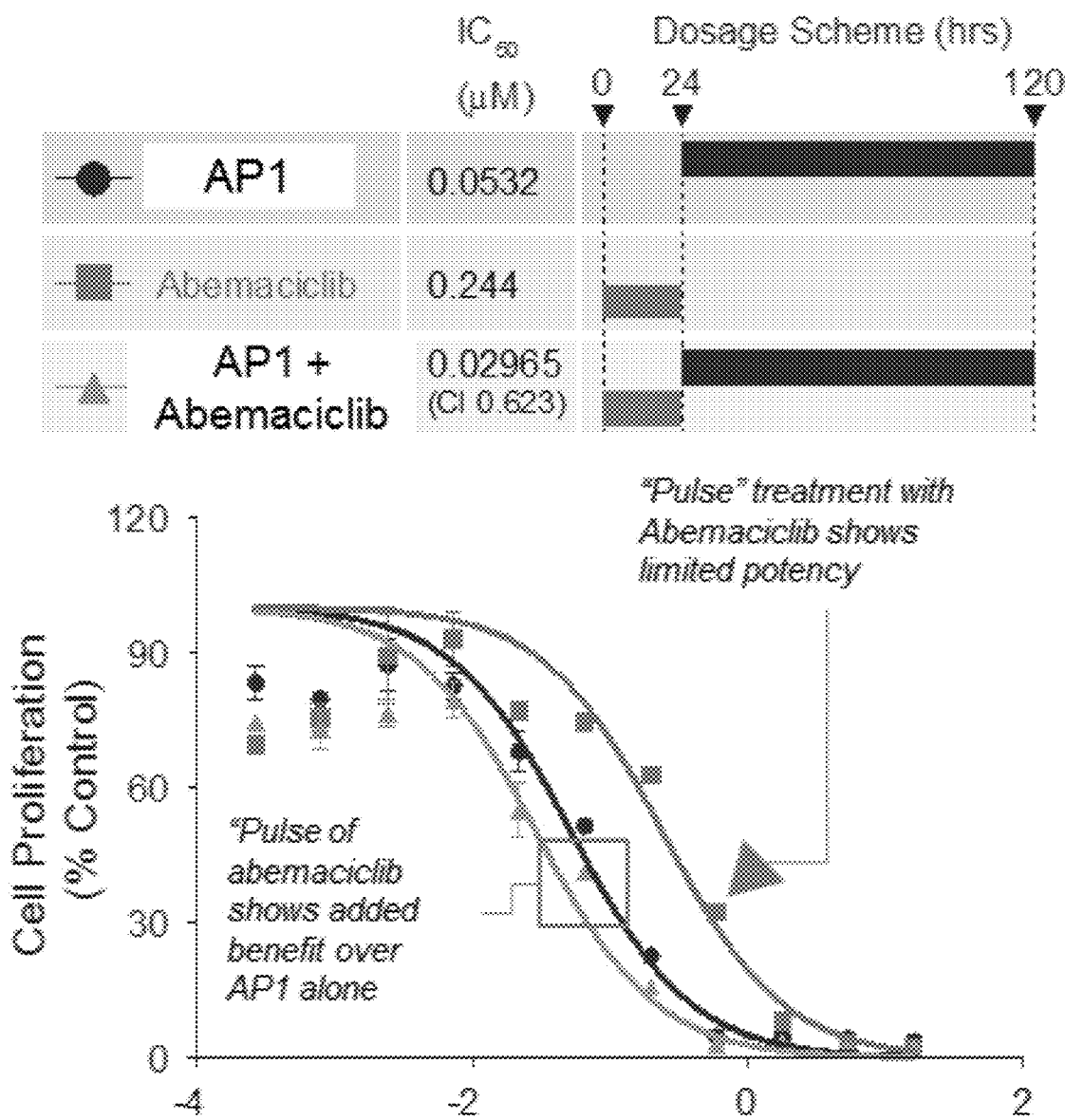
FIG. 22 shows that a 24 hour pulse treatment with abemaciclib alone showed limited potency in anti-proliferative activity in SJSA1 cells compared to cells that received a 24 hours pulse of abemaciclib followed by treatment with AP1. The latter showed enhanced anti-proliferative activity over treatment with AP1 alone.

AP1 in combination with abemaciclib displayed synergistic in vitro anti-proliferative activity in SJSA1 cells. Abemaciclib was more potent in SJSA1 than palbociclib, and yielded a better CI with AP. Abemaciclib also enhanced sustained anti-proliferative effects of a 24 hour AP1 pulse treatment. In contrast to palbociclib in SJSA1, a 24 hour pulse of abemaciclib showed an added benefit over treatment with AP1 alone. FIG. 20 shows that combination treatment with AP1 and abemaciclib displayed a synergistic effect in anti-proliferative activity in SJSA1 cells. FIG. 21 shows that treating SJSA1 cells with a 24 hour pulse of AP1 followed by treatment with abemaciclib resulted in sustained anti-proliferative activity compared to treatment with AP1 or abemaciclib alone. FIG. 22 shows that a 24 hour pulse treatment with abemaciclib alone showed limited potency in anti-proliferative activity in SJSA1 cells compared to cells that received a 24 hours pulse of abemaciclib followed by treatment with AP1, which showed enhanced anti-proliferative activity over treatment with AP1 alone.

Figure 23:
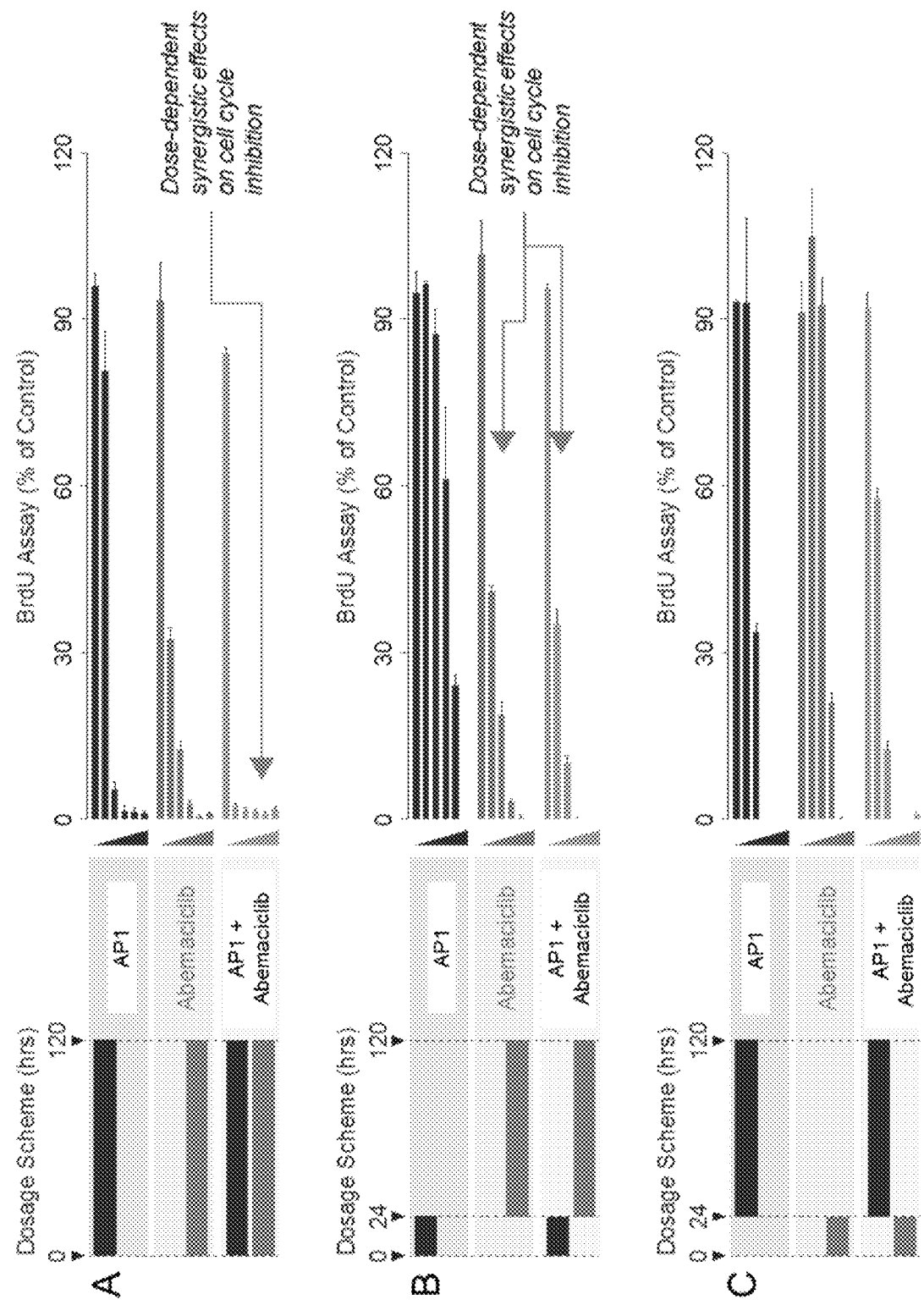
FIG. 23 PANEL A shows that simultaneous treatment with AP1 and abemaciclib resulted in dose-dependent synergistic effects on cell cycle inhibition compared to treatment with AP1 or abemaciclib alone.

BrdU incorporation assays showed synergistic cell cycle inhibition by combination treatment with AP1 and abemaciclib in SJSA1 cells. FIG. 23 PANEL A shows that simultaneous treatment with AP1 and abemaciclib resulted in dose-dependent synergistic effects on cell cycle inhibition compared to treatment with AP1 or abemaciclib alone. FIG. 23 PANEL B shows that a 24 hour pulse treatment with AP1 followed by treatment with abemaciclib resulted in dose-dependent synergistic effects on cell cycle inhibition compared to a 24 hour pulse treatment of AP1 alone or a 96 hour treatment with abemaciclib alone. FIG. 23 PANEL C shows that a 24 hour pulse treatment with abemaciclib followed by treatment with AP1 resulted in dose-dependent synergistic effects on cell cycle inhibition compared to a 24 hour pulse treatment of abemaciclib alone or a 96 hour treatment with abemaciclib alone.

Figure 24:
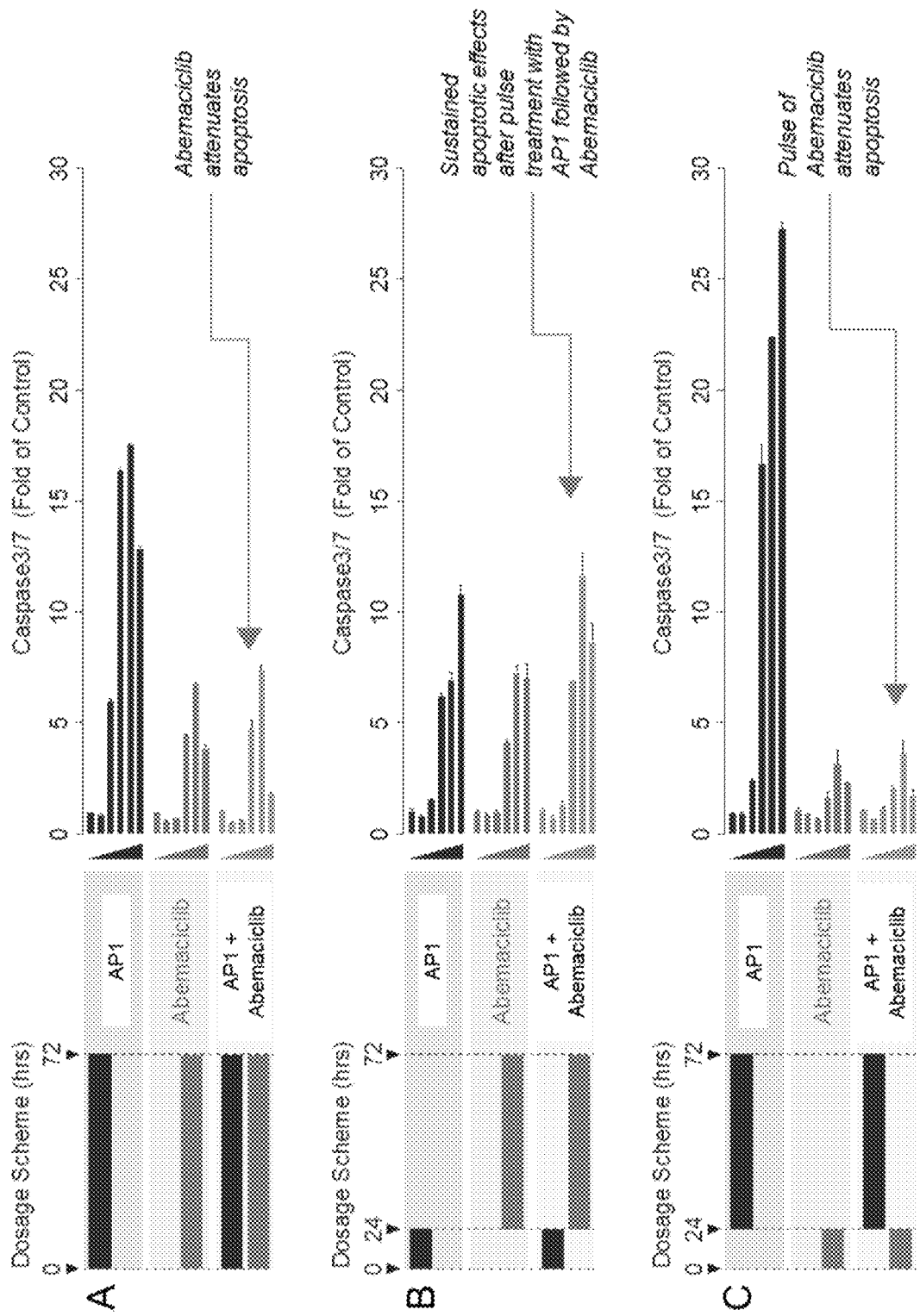
FIG. 24 PANEL A shows that treatment with abemaciclib attenuated apoptosis in SJSA1 cells.

Apoptosis assays showed sustained apoptotic effects after 24 hour pulse treatments with AP1 followed by abemaciclib in SJSA1 cells. FIG. 24 PANEL A shows that treatment with abemaciclib attenuated apoptosis in SJSA1 cells. FIG. 24 PANEL B shows that a 24 hour pulse treatment with AP1 followed by treatment with abemaciclib resulted in sustained apoptotic effects in SJSA1 cells. FIG. 24 PANEL C shows that a 24 hour pulse treatment with abemaciclib attenuated apoptosis in SJSA1 cells.

Figure 25:
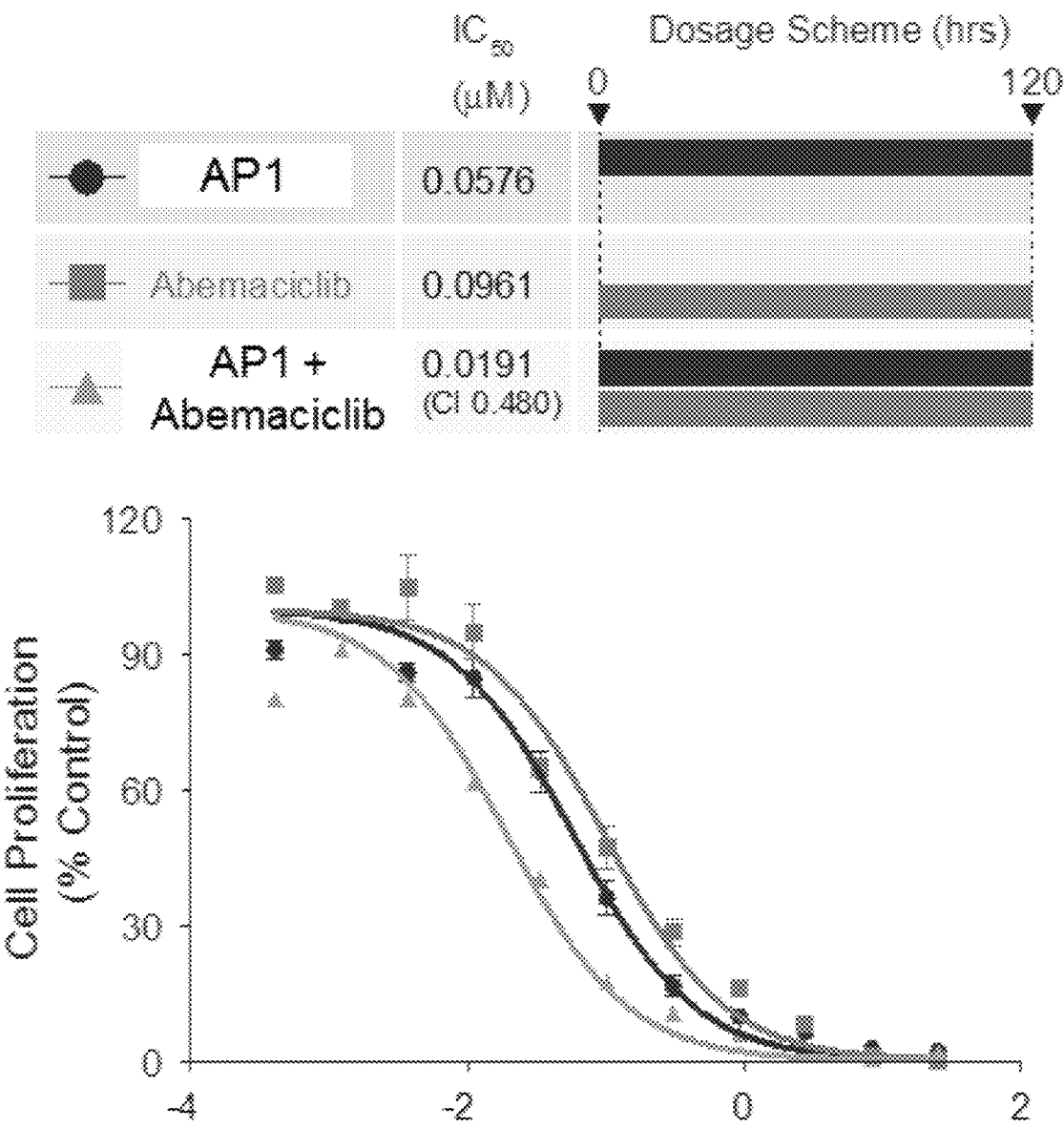
FIG. 25 shows that concomitant treatment with AP1 and abemaciclib resulted in a synergistic effect in anti-proliferative activity in MCF7 cells.
Figure 26:
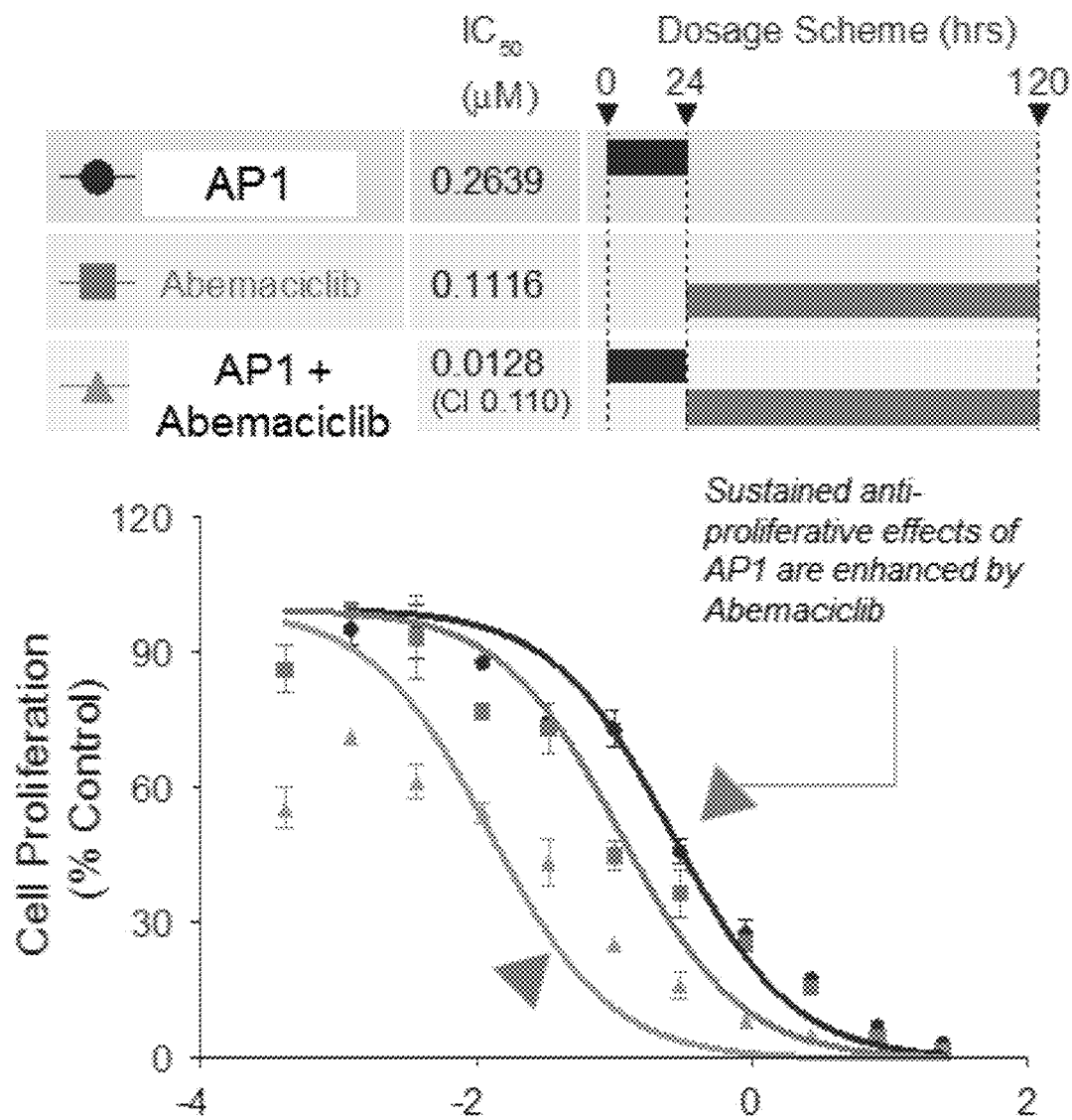
FIG. 26 shows that a 24 hour pulse treatment with AP1 followed by treatment with abemaciclib resulted in sustained anti-proliferative effects compared to treatment with AP1 or abemaciclib alone.
Figure 27:
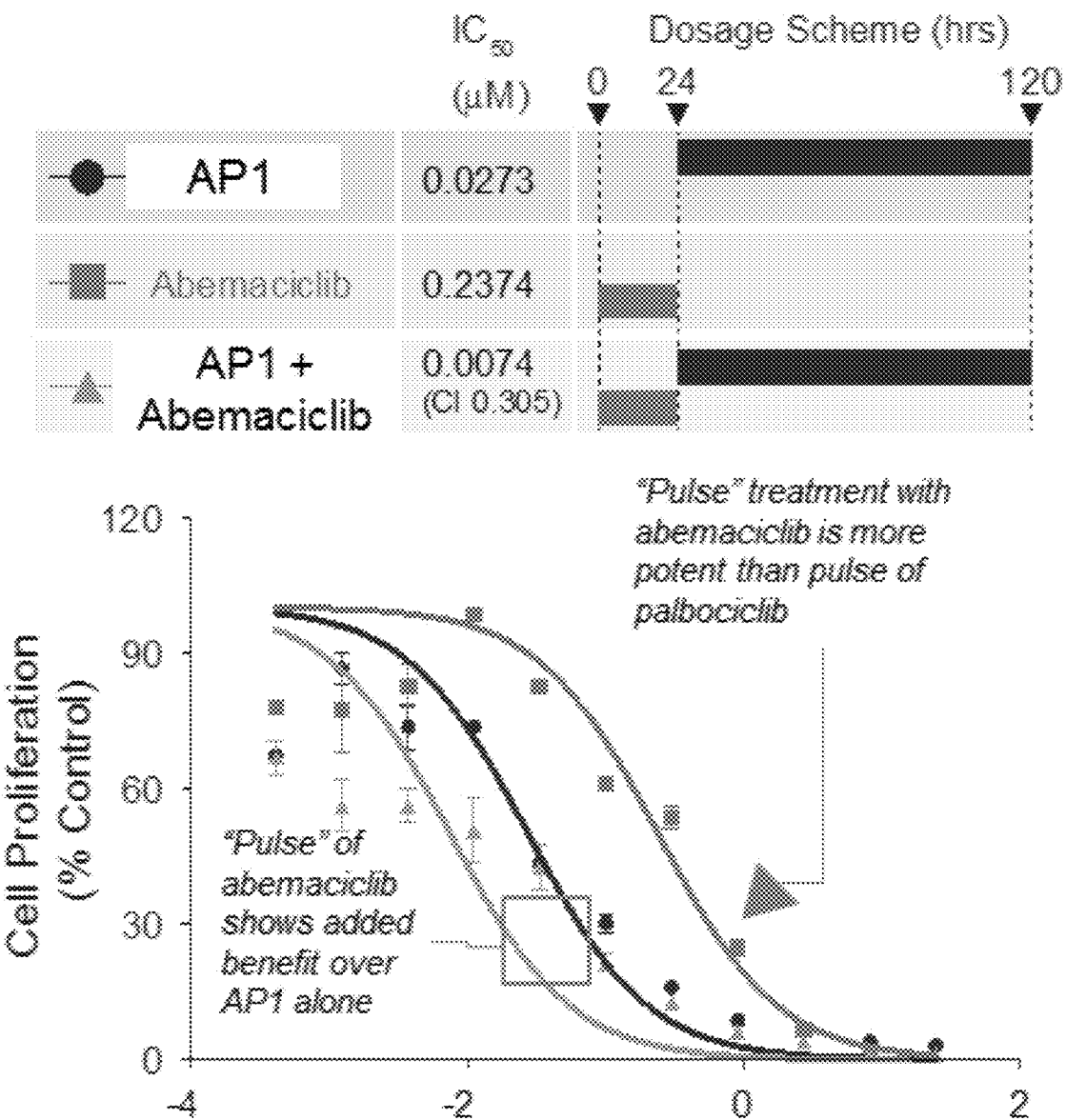
FIG. 27 shows that a 24 hour pulse treatment with abemaciclib had an added benefit over treatment with AP1 alone.

Combination treatment with AP1 and abemaciclib displayed synergistic in vitro anti-proliferative activity in MCF7 cells. Synergy was observed upon concomitant dosing of AP1 and abemaciclib. Sustained antiproliferative effects of 24 hour AP1 pulse treatments were enhanced by abemaciclib. A 24 hour pulse treatment with abemaciclib in MCF7 cells showed an added benefit over treatment of the cells with AP1 alone. FIG. 25 shows that concomitant treatment with AP1 and abemaciclib resulted in a synergistic effect in anti-proliferative activity in MCF7 cells. FIG. 26 shows that a 24 hour pulse treatment with AP1 followed by treatment with abemaciclib resulted in sustained anti-proliferative effects compared to treatment with AP1 or abemaciclib alone. FIG. 27 shows that a 24 hour pulse treatment with abemaciclib had an added benefit over treatment with AP1 alone. The pulse treatment with abemaciclib was more potent than a pulse treatment with palbociclib.

Figure 28:
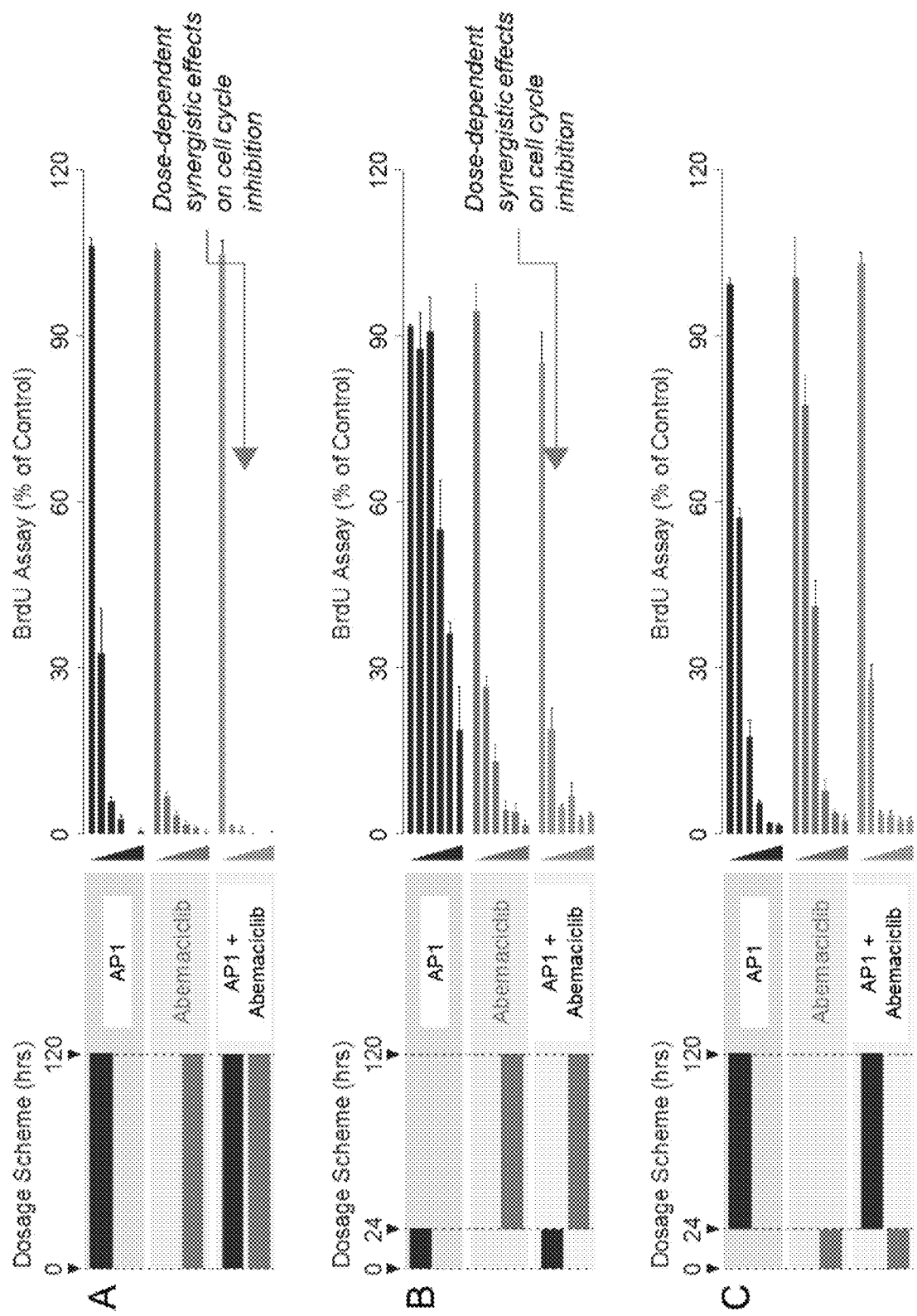
FIG. 28 PANEL A shows that concomitant treatment with AP1 and abemaciclib resulted in dose-dependent synergistic effects on cell cycle inhibition in MCF7 cells.

BrdU incorporation assays showed synergistic cell cycle inhibition by AP1 and abemaciclib combination treatment in MCF7 cells. FIG. 28 PANEL A shows that concomitant treatment with AP1 and abemaciclib resulted in dose-dependent synergistic effects on cell cycle inhibition in MCF7 cells. FIG. 28 PANEL B shows that a 24 hour pulse treatment with AP1 followed by treatment with abemaciclib resulted in dose-dependent synergistic effects on cell cycle inhibition in MCF7 cells. FIG. 28 PANEL C shows that a 24 hour pulse treatment with abemaciclib followed by treatment with AP1 resulted in synergistic effects on cell cycle inhibition in MCF7 cells.

Figure 29:
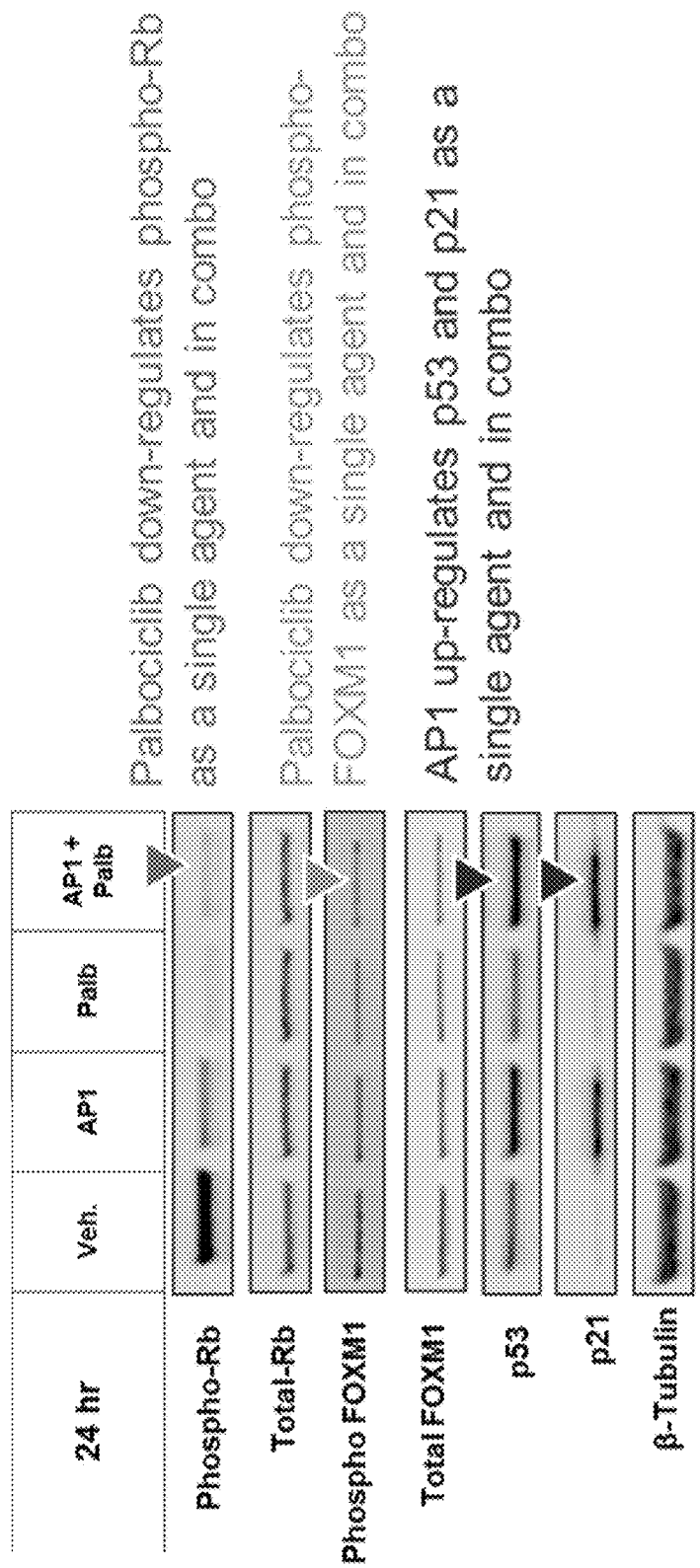
FIG. 29 shows that palbociclib down-regulated phospho-Rb as a single agent and in combination with AP1; palbociclib down-regulated phospho-FOXM1 as a single agent and in combination with AP1; and AP1 up-regulated p53 and p21 as a single agent and in combination with palbociclib.
Figure 30:
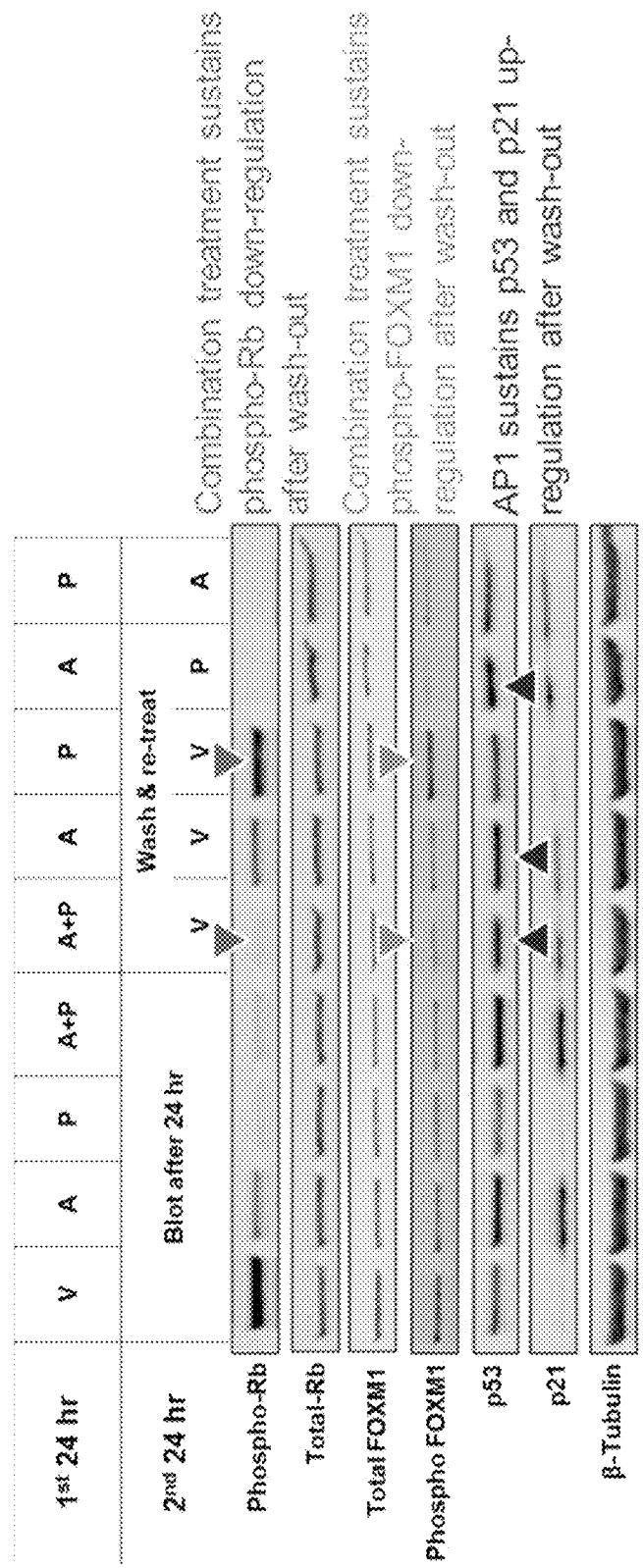
FIG. 30 shows that combination treatment with AP1 and palbociclib sustained phospho-Rb down-regulation after washout; combination treatment with AP1 and palbociclib sustained phospho-FOXM1 down-regulation after washout; and that AP1 sustained p53 and p21 up-regulation after washout.

Western blot analysis of phosphorylated Rb, FOXM1, p53, and p21 demonstrated that combination treatment with palbociclib and AP1 enhanced the activity of one another by on-mechanism cell cycle arrest and cancer cell killing. FIG. 29 shows that palbociclib down-regulated phospho-Rb as a single agent and in combination with AP1; palbociclib down-regulated phospho-FOXM1 as a single agent and in combination with AP1; and AP1 up-regulated p53 and p21 as a single agent and in combination with AP1. Western blot assays also showed that AP1 and palbociclib combination treatment yielded sustained biomarker activation in SJSA1 cells. FIG. 30 shows that combination treatment with AP1 and palbociclib sustained phospho-Rb down-regulation after washout; combination treatment with AP1 and palbociclib sustained phospho-FOXM1 down-regulation after washout; and that AP1 sustained p53 and p21 up-regulation after washout.

Figure 31:
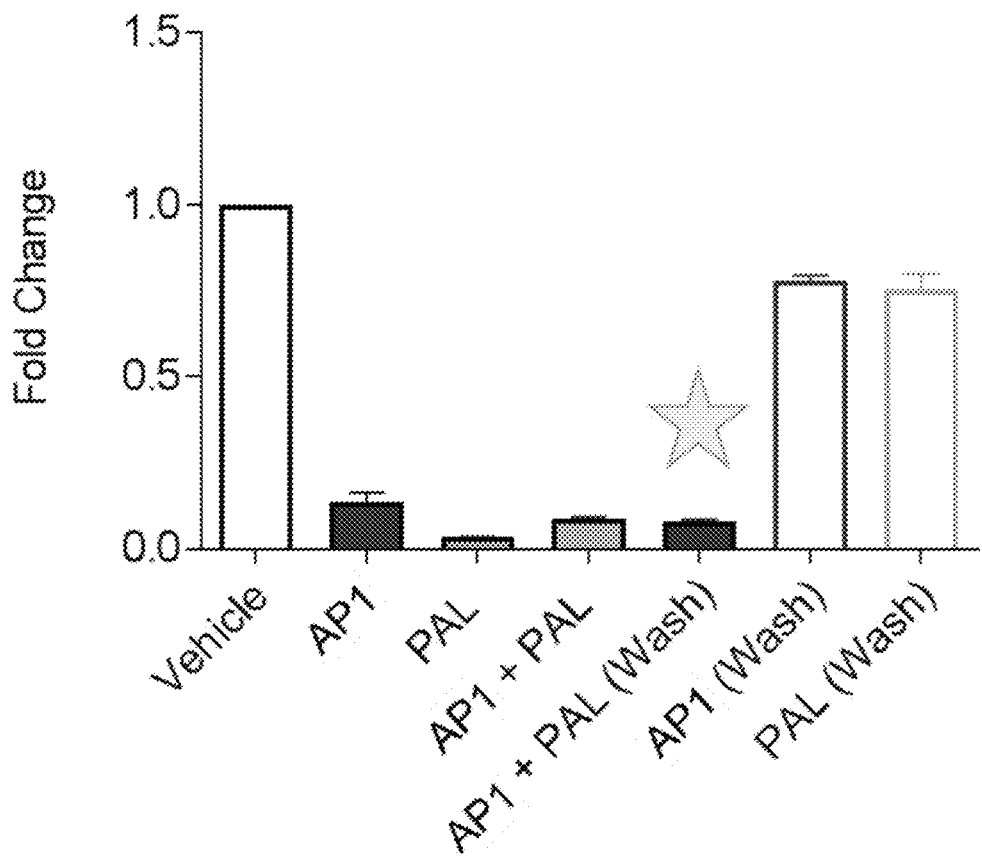
FIG. 31 shows that combination treatment with AP1 and palbociclib resulted in sustained repression of E2F1 mRNA in SJSA1 cells following wash-out (star symbol).

Combination treatment with AP1 and palbociclib yielded sustained repression of E2F1 mRNA in SJSA1 cells following wash-out. FIG. 31 shows that combination treatment with AP1 and palbociclib resulted in sustained repression of E2F1 mRNA in SJSA1 cells following wash-out (star symbol). In contrast, cells treated with AP1 alone or palbociclib alone did not exhibit repression of E2F1 mRNA in SJSA1 cells following wash-out.

The combination of AP1 and palbociclib was also tested in MCF7 and SJSA1 mouse xenograft models. SJSA1 harbors DNA amplification of both MDM2 and CDK4 genes, which neighbor one another on chromosome 12q, while MCF7 harbors a deletion of the CDKN2A gene, the product of which is a natural inhibitor of MDM2 and CDK4. Athymic nu/nu mice were xenotransplanted with MCF7 or SJSA1 cells and then treated with either vehicle, AP1 alone once-weekly for 21 days, palbociclib alone once daily for 21 days, or a combination of AP1 and palbociclib with AP1 dosed either 6 hours before or 6 hours after palbociclib on days when AP1 and palbociclib were dosed together. TABLE 13 shows the mouse xenograft study design for AP1+palbociclib combination treatment studies to measure tumor growth inhibition and progression free survival in MCF7 and SJSA1 animal models.

TABLE 13

| Gr. | N | Regimen 1 | | | | Regimen 2 | | | |
| --- | --- | --- | --- | --- | --- | --- | --- | --- | --- |
| | | Agent | mg/kg | Route | Schedule | Agent | mg/kg | Route | Schedule |
| 1 | 10 | vehicle 1 | — | iv | qwk × 4 | vehicle 2 | — | po | qd × 21 |
| 2 | 10 | AP1 | 20 | iv | qwk × 4 | vehicle 2 | — | po | qd × 21 |
| 3 | 10 | palbociclib | 75 | po | qd × 21 | vehicle 1 | — | iv | qwk × 4 |
| 4 | 10 | AP1 | 20 | iv | qwk × 4 | palbociclib | 75 | po | qd × 21 |

TABLE 13-continued

| Gr. | N | Regimen 1 | | | | Regimen 2 | | | |
|---|---|---|---|---|---|---|---|---|---|
| | | Agent | mg/kg | Route | Schedule | Agent | mg/kg | Route | Schedule |
| 5 | 10 | palbociclib | 75 | po | qd × 21 | AP1 | 20 | iv | dose 6 hours post AP1 qwk × 4 dose 6 hours post palbociclib |

Figure 32:
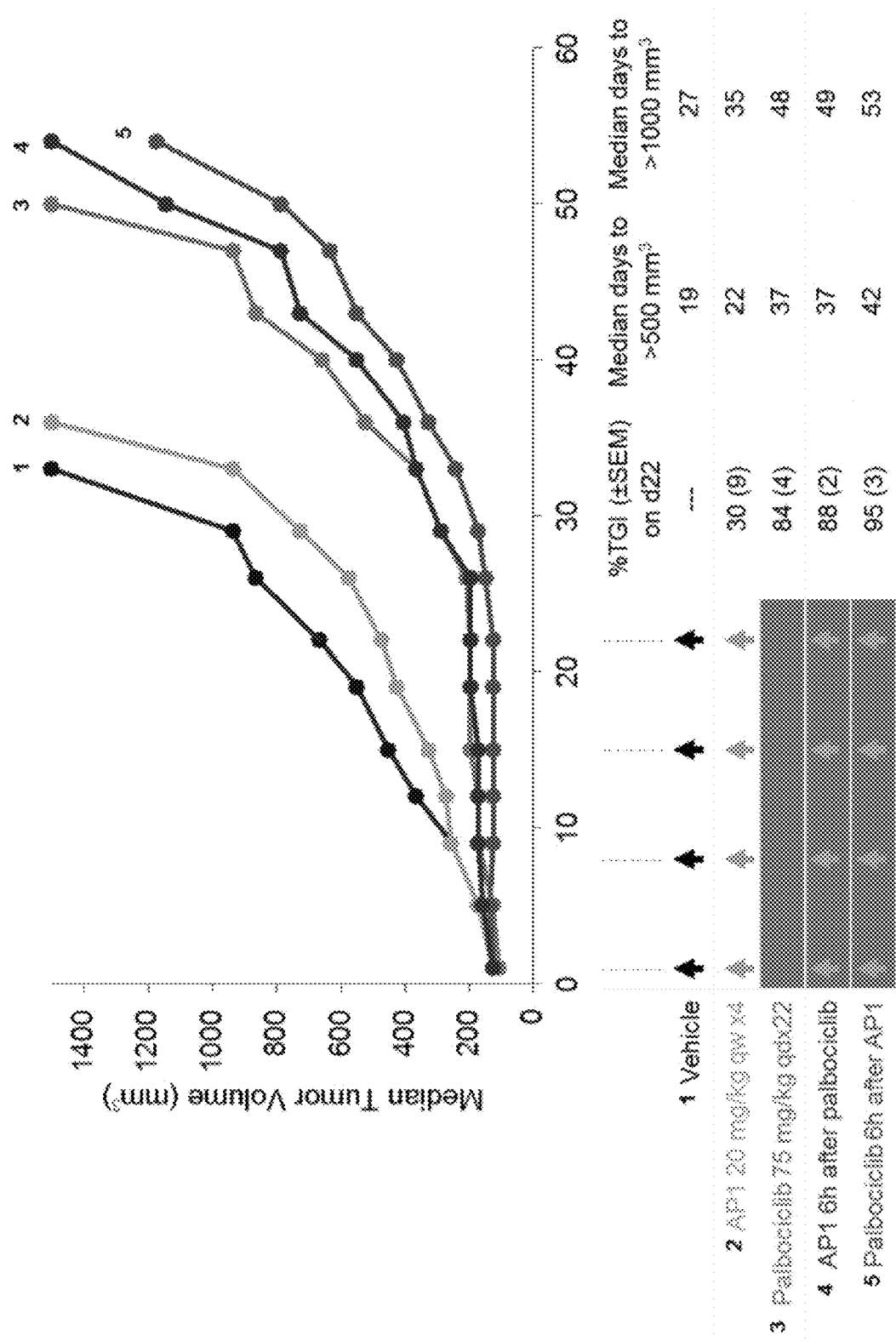
FIG. 32 shows that the combination of AP1 and palbociclib yielded 11-65% greater tumor growth inhibition than treatment with AP1 or palbociclib alone yielded in the MCF7 mouse xenograft model.
Figure 33:
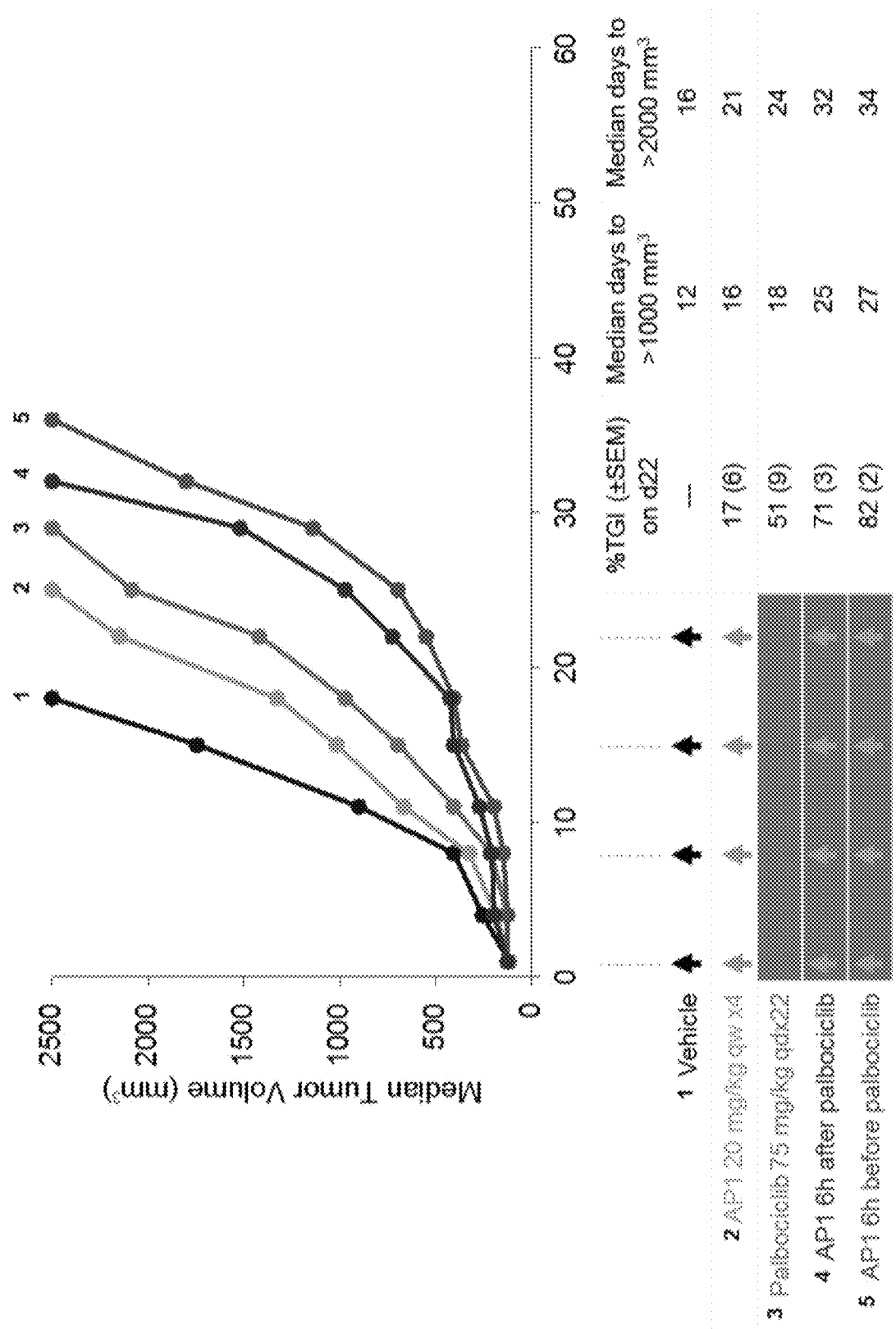
FIG. 33 shows that the combination of AP1 and palbociclib yielded 31-82% greater tumor growth inhibition than treatment with AP1 or palbociclib alone yielded in the SJSA1 mouse xenograft model.
Figure 34:
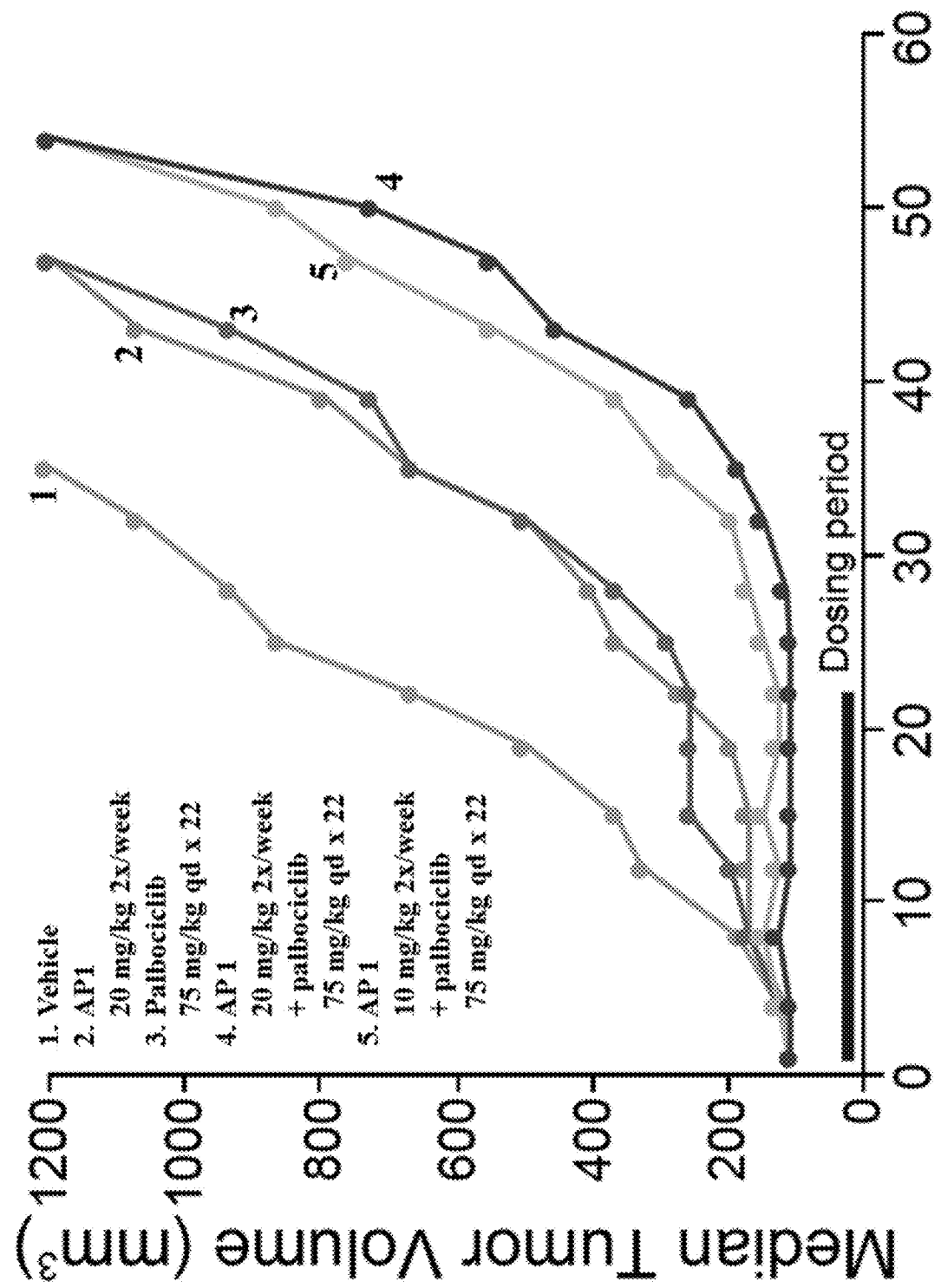
FIG. 34 shows that AP1 in combination with palbociclib yielded better MCF7 tumor growth inhibition and progression free survival than either single agent alone yielded.
Figure 35:
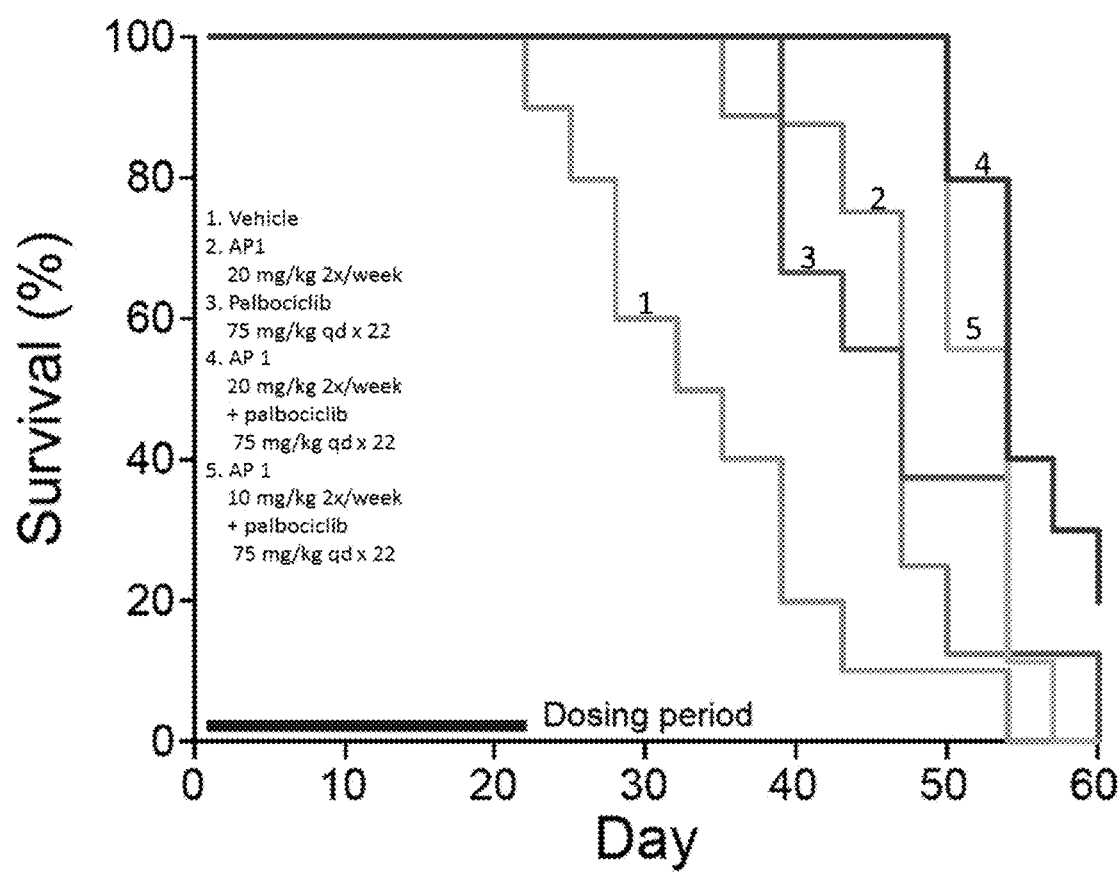
FIG. 35 shows survival curves of mice with MCF7 tumors treated with AP1, palbociclib, or a combination thereof.

FIG. 32 shows that the combination of AP1 and palbociclib yielded 11-65% greater tumor growth inhibition than treatment with AP1 or palbociclib alone yielded in the MCF7 mouse xenograft model. FIG. 33 shows that the combination of AP1 and palbociclib yielded 31-82% greater tumor growth inhibition than treatment with AP1 or palbociclib alone yielded in the SJSA1 mouse xenograft model. FIG. 34 shows that AP1, administered biweekly at either 10 mg/kg or 20 mg/kg, in combination with palbociclib (dosed qd for 22 days) yielded better MCF7 tumor growth inhibition and progression free survival than either single agent alone yielded. As can be seen in FIG. 35, combination treatment with palbociclib and AP1 prolonged survival compared to treatment with AP1 alone.

Figure 36:
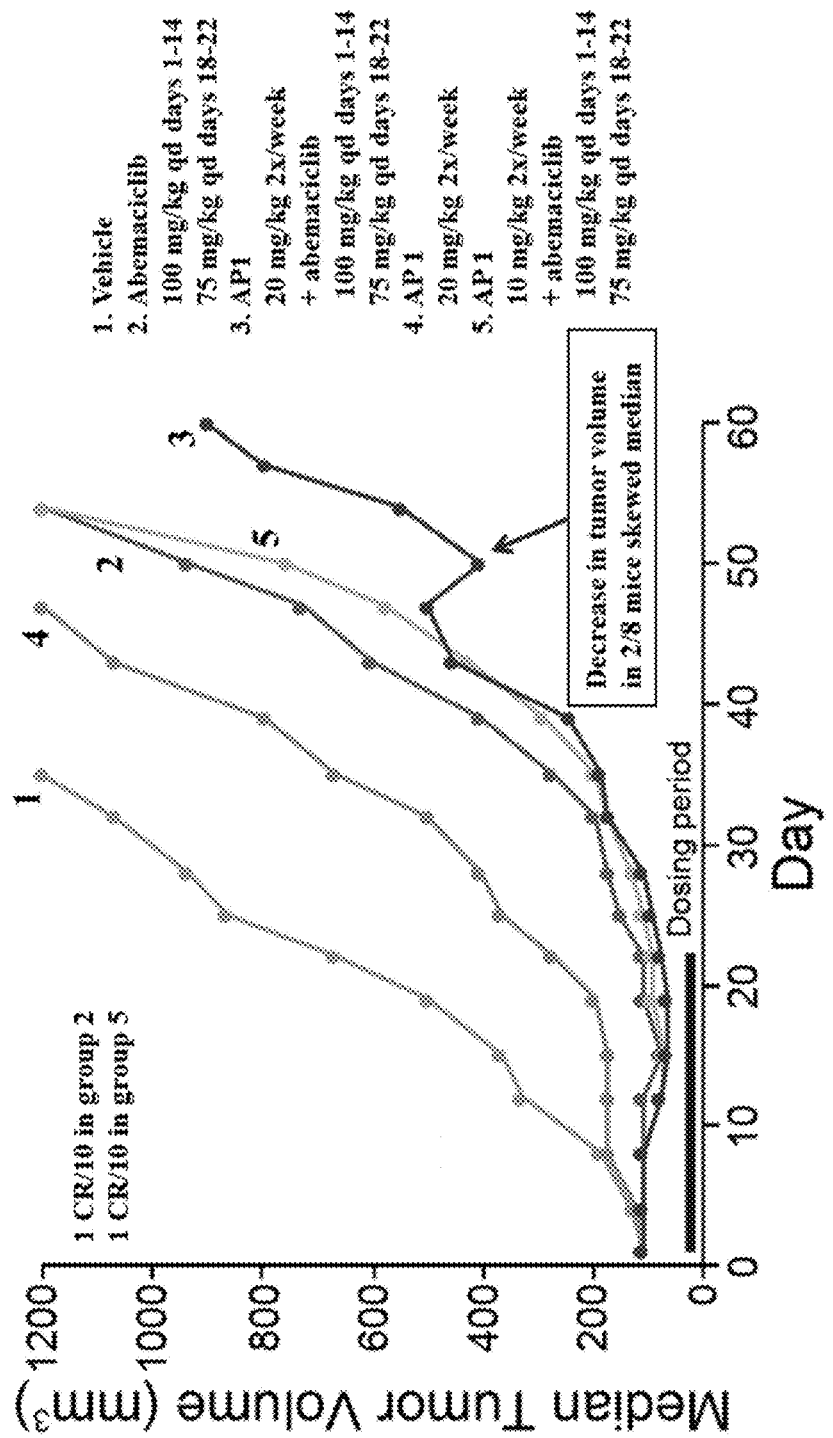
FIG. 36 shows that combination treatment with AP1 and abemaciclib resulted in a decrease in tumor volume in 2/8 of mice.
Figure 37:
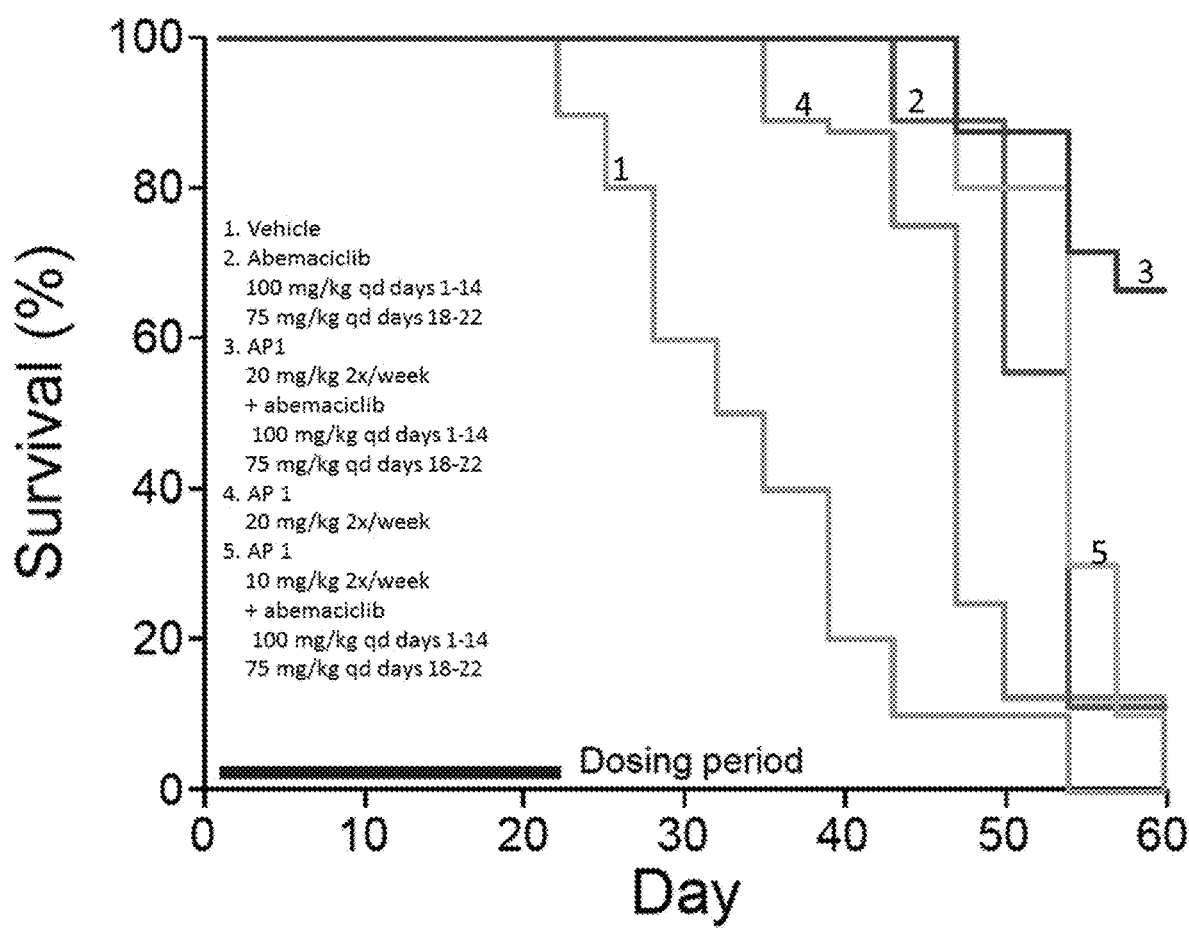
FIG. 37 shows survival curves of mice with MCF tumors treated with AP1, abemaciclib, or a combination thereof.

FIGS. 36 and 37 show the effects of combination treatment with AP1 and abemaciclib in the MCF7 mouse xenograft model. For abemaciclib treatments, mice were dosed qd at 100 mg/kg for days 1-14, then put on drug holidays on day 14 due to body weight loss. Dosing was resumed at 75 mg/kg qd. AP1 was dosed at either 10 mg/kg or 20 mg/kg twice per week, with the exception of during the aforementioned drug holiday. Combination treatment with AP1 at 20 mg/kg twice a week and abemaciclib resulted in a decrease in tumor volume in 2/8 of mice and also lead to prolonged survival compared to treatment with either single agent alone.

Figure 38:
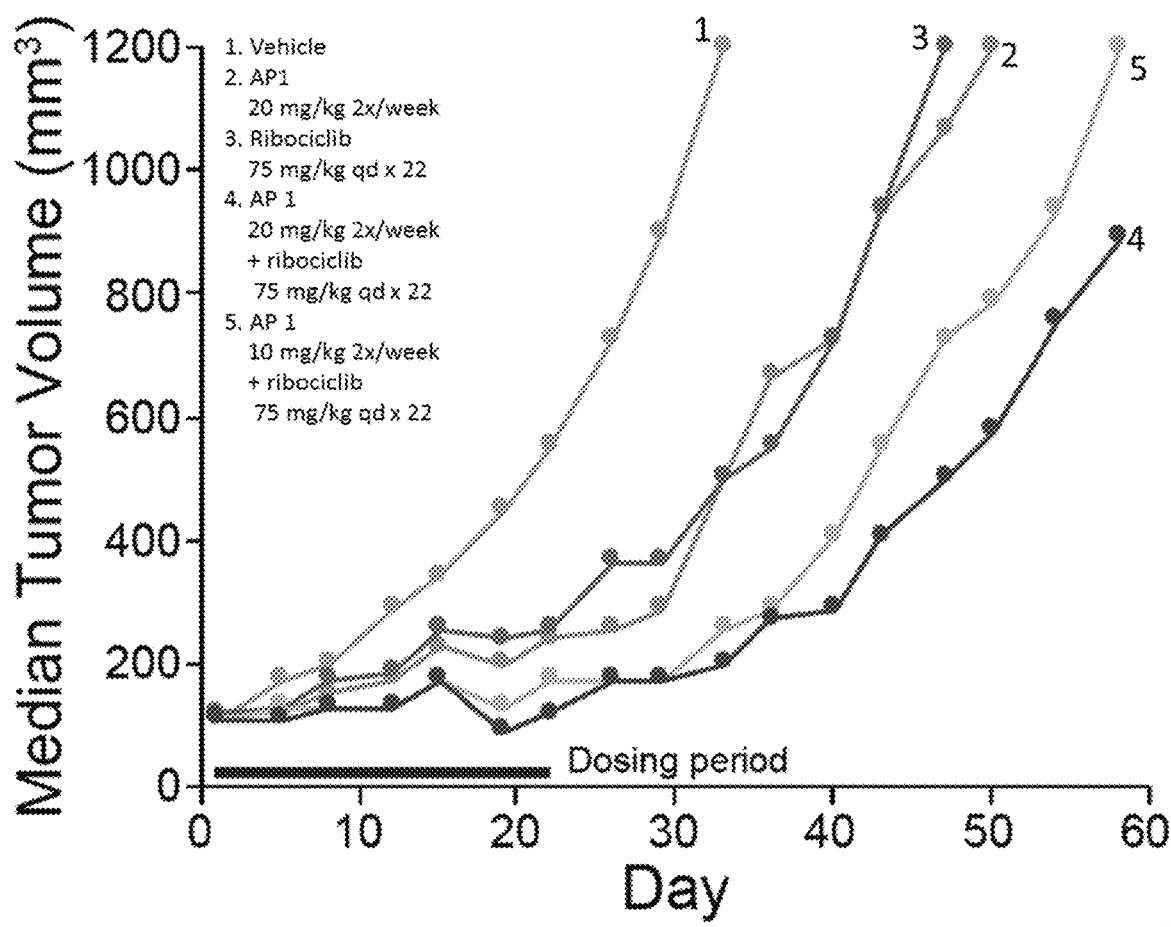
FIG. 38 shows that AP1 in combination with ribociclib yielded better MCF7 tumor growth inhibition than either single agent alone yielded.
Figure 39:
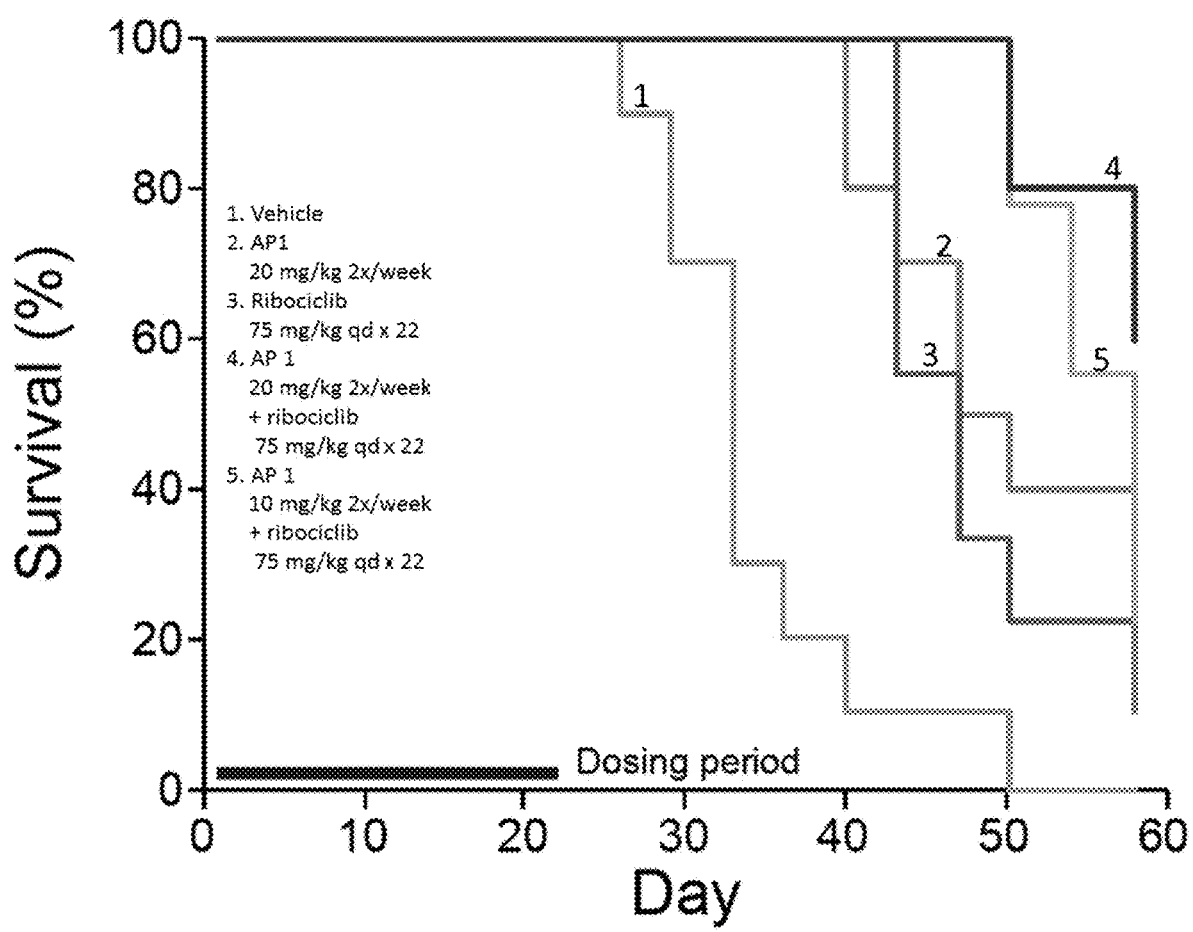
FIG. 39 shows survival curves of mice with MCF7 tumors treated with AP1, ribociclib, or a combination thereof.

FIG. 38 shows the effects of combination treatment with AP1 and ribociclib in the MCF-7 xenograft model. Mice were in 5 treatment groups. Group 1 received a vehicle control. Group 2 was treated with ribociclib at 75 mg/kg qd for 22 days. Group 3 was treated with AP1 at 20 mg/kg biweekly over the course of 22 days. Group 4 was treated with 10 mg/kg AP1 twice per week in combination with 75 mg/kg ribociclib qd for 22 days. Group 5 was treated with 20 mg/kg AP1 twice per week in combination with 75 mg/kg ribociclib qd for 22 days. Results showed that treating with the combination of AP1 and ribociclib resulted in greater tumor growth inhibition than either single agent alone did. Moreover, combination treatment with AP1 and ribociclib prolonged the survival of mice compared to mice receiving treatment with either single agent alone, as seen in FIG. 39.

Figure 40:
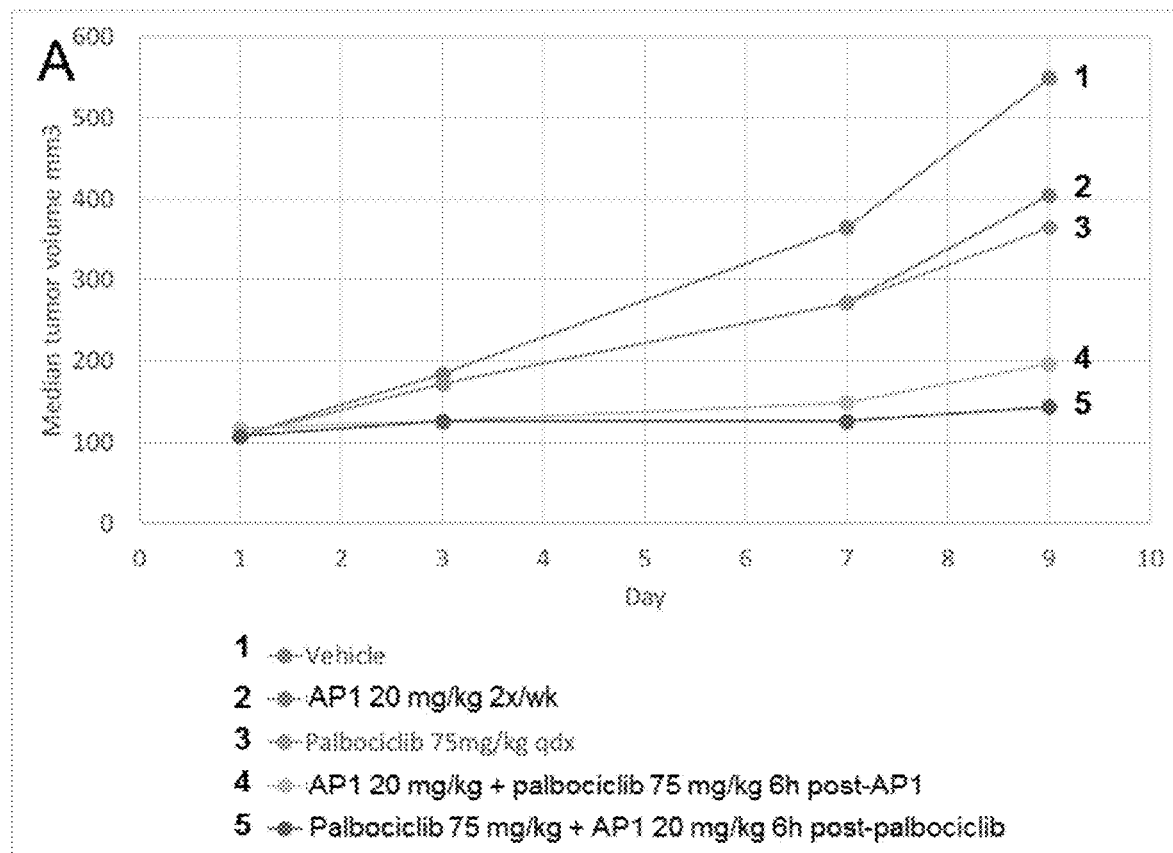
FIG. 40 PANEL A shows that SJSA1 xenograft model tumors exhibited the smallest increase in median tumor volume when treated with AP1 (20 mg/kg)+palbociclib (75 mg/kg 6 hours post AP1) or palbociclib (75 mg/kg)+AP1 (20 mg/kg 6 hours post-palbociclib).
Figure 40:
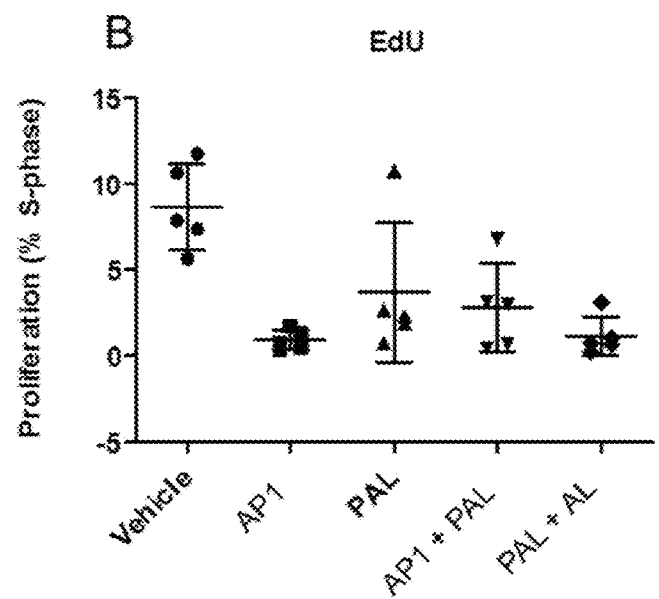

Edu incorporation assays showed that combination treatment with AP1 and palbociclib inhibited SJSA1 tumor cell proliferation in vivo. SJSA1 xenograft model tumors were sampled on day 9, 4 hours after dosing with Edu and 25 hours after dosing with vehicle, AP1 (BIW days 1, 4, 8), palbociclib (QD×8), or a combination of AP1 and palbociclib (drug administration sequenced±6 hours). The tumors were then homogenized and assayed by flow cytometry. FIG. 40 PANEL A shows that SJSA1 xenograft model tumors exhibited the smallest increase in median tumor volume when treated with AP1 (20 mg/kg)+palbociclib (75 mg/kg 6 hours post AP1) or palbociclib (75 mg/kg)+AP1 (20 mg/kg 6 hours post-palbociclib). FIG. 40 PANEL B shows that treatment of SJSA xenograft model tumors with AP1, palbociclib, or combinations of AP1 and palbociclib resulted in decreased cell proliferation.

Figure 41:
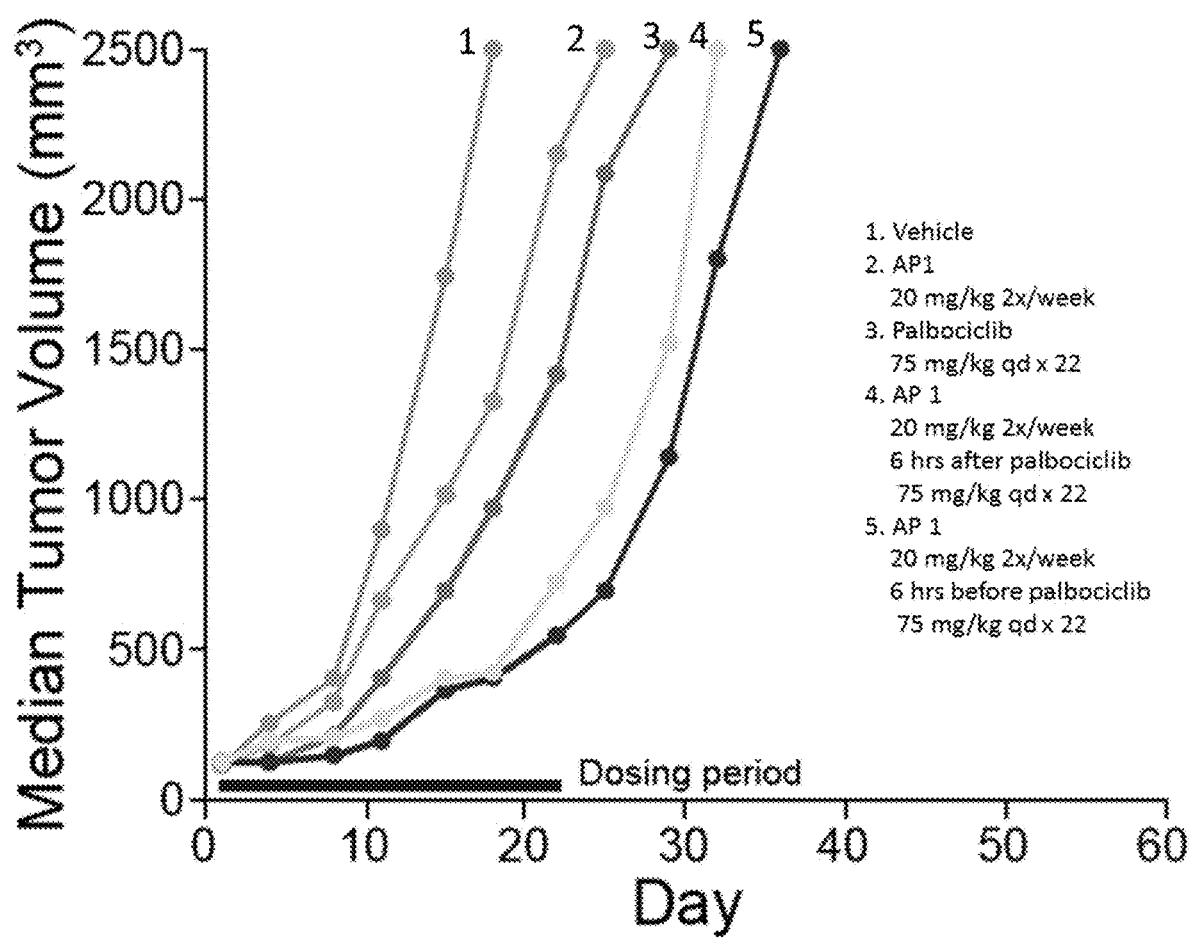
FIG. 41 shows that SJSA1 xenograft model tumors exhibited the smallest increase in median tumor volume when treated with AP1 (20 mg/kg)+palbociclib (75 mg/kg 6 hours post AP1) or palbociclib (75 mg/kg)+AP1 (20 mg/kg 6 hours post-palbociclib).
Figure 42:
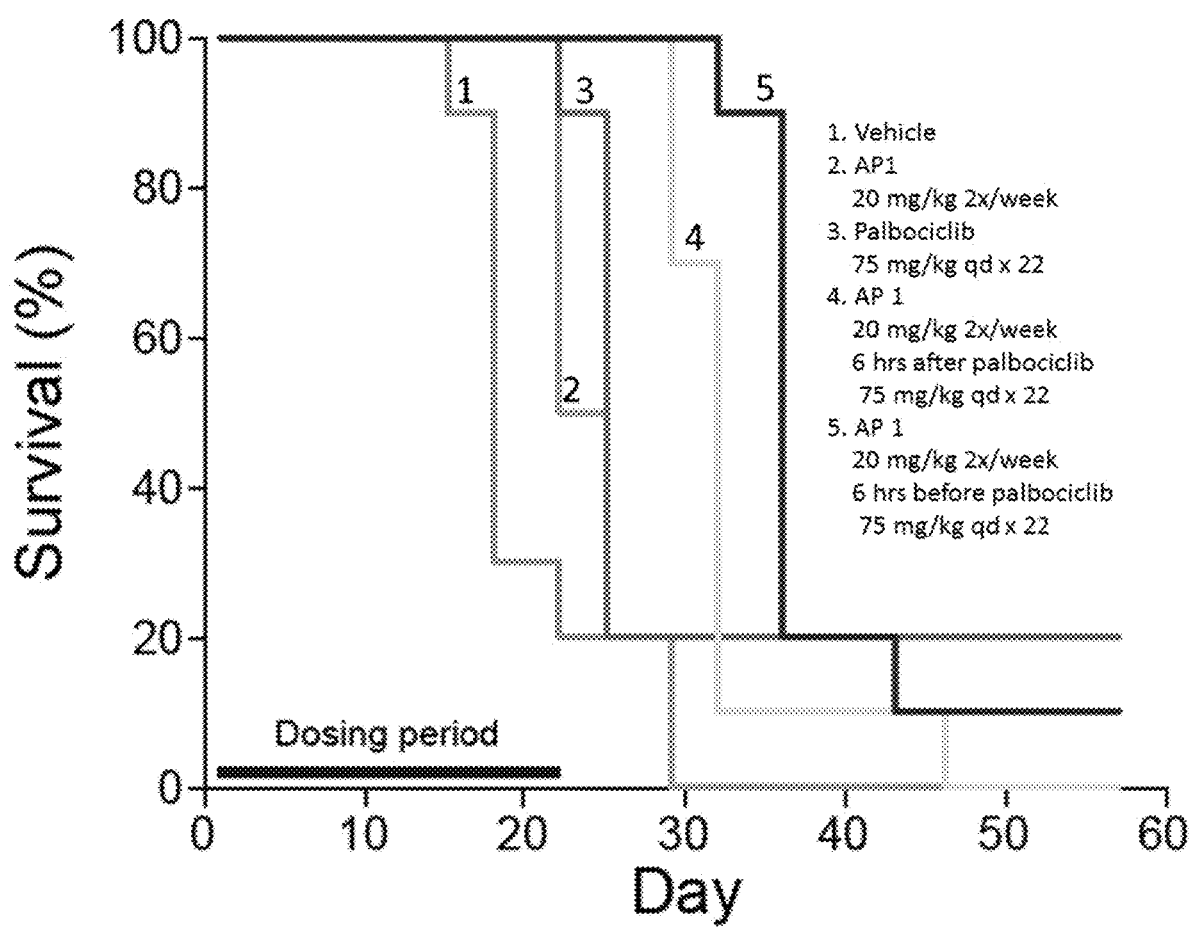
FIG. 42 shows survival curves of mice treated with vehicle, AP1 (20 mg/kg twice per week), palbociclib (75 mg/kg qd), AP1 (20 mg/kg)+palbociclib (75 mg/kg 6 hours post AP1) or palbociclib (75 mg/kg)+AP1 (20 mg/kg 6 hours post-palbociclib).

FIG. 41 shows the effects of combination treatment with AP1 and palbociclib in the SJSA1 xenograft model for time periods longer than 9 days. Mice were in 5 treatment groups. Group 1 received a vehicle control. Group 2 was treated with palbociclib at 75 mg/kg qd for 22 days. Group 3 was treated with AP1 at 20 mg/kg biweekly over the course of 22 days. Group 4 was treated with 20 mg/kg AP1 twice per week in combination with 75 mg/kg ribociclib qd for 22 days. Mice in group 4 received AP1 doses 6 hours after receiving the daily palbociclib dose. Group 5 was treated with 20 mg/kg AP1 twice per week in combination with 75 mg/kg ribociclib qd for 22 days. Mice in group 5 received AP1 doses 6 hours before receiving the daily palbociclib dose. Results showed that combination treatment with AP1 and palbociclib increased tumor growth inhibition compared to treatment with either single agent alone. The effect of various treatment regimens on mouse survival is shown in FIG. 42.

Example 21: Pharmacokinetics of AP1 Administered in Combination with Palbociclib AP1 and palbociclib are metabolized and eliminated by independent mechanisms. AP1 is metabolized by proteolysis, and eliminated upon hepatic uptake and biliary excretion. Palbociclib is primarily metabolized by CYP3A and SULT2A1 with the major metabolite in feces as the sulfamic acid conjugate. Concomitant use of strong CYP3A inhibitors and moderate and strong CYP3A inducers is not advised while on palbociclib therapy. Doses of sensitive CYP3A substrates with a narrow therapeutic index can be reduced, as palbociclib can increase exposure of the CYP3A substrates. Palbociclib, at clinically relevant concentrations, has a low potential to inhibit transporters P-gp, BCRP, OAT1, OAT3, OCT2, OATP1B1 and OATP1B3, and oral absorption of palbociclib is unlikely to be affected by P-gp- and BCRP-mediated transport. Studies with AP1 indicated a low likelihood of induction or inhibition of cytochrome P450 (CYP) enzymes, suggesting any metabolism based drug-drug interactions between AP1 and palbociclib are unlikely.

AP1 and palbociclib were administered by intravenous and oral routes, respectively, with minimum interaction at the gut level. Food is recommended with the administration of palbociclib. Under fed conditions no clinically relevant effects were observed using proton pump inhibitors, H2-receptor antagonists, or local antacids on palbociclib exposure.

Figure 43:
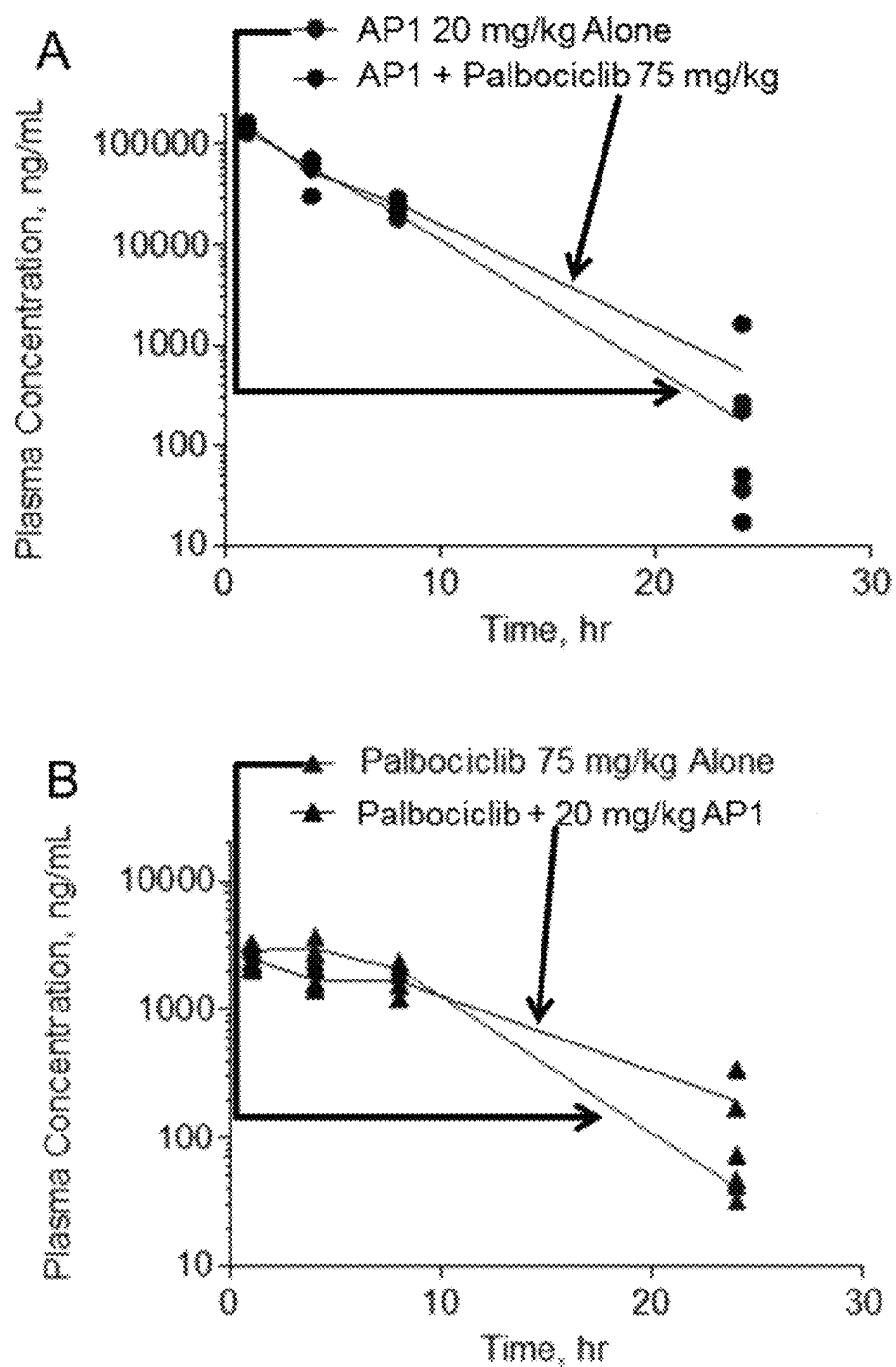
FIG. 43 PANEL A compares the plasma concentrations of AP1 when administered alone (20 mg/kg) or in combination with palbociclib (75 mg/kg).

In non-tumor-bearing nu/nu mice, the PK of AP1 was not affected by palbociclib and vice versa. FIG. 43 PANEL A compares the plasma concentrations of AP1 when administered alone (20 mg/kg) or in combination with palbociclib (75 mg/kg). FIG. 43 PANEL B compares the plasma concentrations of palbociclib when administered alone (75 mg/kg) or in combination with AP1 (20 mg/kg). TABLE 14 shows the pharmacokinetic parameters of AP1 and palbociclib when administered alone or in combination in Nu/nu mice.

TABLE 14

|  | Alone | | Co-administered | |
|---|---|---|---|---|
|  | $C_{max}$ µg/mL | $AUC_{last}$ µg · hr/mL | $C_{max}$ µg/mL | $AUC_{last}$ µg · hr/mL |
| AP1 | 138 | 686 | 156 | 759 |
| Palbociclib | 2.9 | 37 | 2.6 | 29 |

Example 22: Disease Control in Human Subjects

Disease control was achieved in 5 out of 7 (71%, including one PR) MDM2-amplified, TP53-WT patients at dose levels ≥3.2 mg/kg/cycle. TABLE 15 summarizes the patient demographics and results of the study.

TABLE 15

| Patient ID | Cohort | Tumor | Best Overall Response | Best % Change from Baseline | MDM2 CN | CDK4 | CDK4 CN |
|---|---|---|---|---|---|---|---|
| 001-003 | 1 | Gallbladder-adenocarcinoma | NE/NA | NA | 15 | Amplification equivocal CN = 6 | Unknown |
| 001-005 | 1 | Liposarcoma | CDP | 11.6 | 276 |  | Unknown |
| 001-015 | 3b | Leiomyosarcoma | SD | 0 | 99 | Amplification CN = 29 | Unknown |
| 006-053 | 4b | Liposarcoma | SD | 15.8 | 100 | Amplification CN = 109, Truncation | Unknown |
| 009-085 | 6a | Bladder carcinoma | PD | 28.8 | 72 |  | <none> |
| 006-098 | 6b | Gastric adenocarcinoma | SD | 15.8 | 23 |  | <none> |
| 006-093 | 6b | Liposarcoma | SD | 0 | 48 | Amplification | 55 |
| 001-115 | 7a | Breast | SD | −13.3 | 11 |  | <none> |
| 009-120 | 7a | Atypical lipomatous tumor | PR | −36.9 | 49 | Amplification | 29 |
| 006-096 | 7b | Well differentiated liposarcoma | SD | 9.8 | 118 | Amplification, CDK4_OS9_rearrangement_44 | 61 |
| 009-116 | 7b | Retroperitoneal liposarcoma | CDP | 11 | 25 | Amplification | 41 |

Example 23: Phase 1/2a Study Objectives a. Phase 1 Dose Escalation Study with AP1 Administered as Single Agent Therapy The primary objectives of the phase 1 dose escalation study with AP1 administered as single agent therapy are to evaluate the safety and tolerability of AP1 in adult patients with advanced solid tumors or lymphomas with wild-type p53 who are refractory to or intolerant of standard therapy, or for whom no standard therapy exists. The dose limiting toxicities (DLTs) and the maximum tolerated dose (MTD) or the optimal biological dose (OBD) of AP1 are also determined in adult patients with advanced solid tumors or lymphomas.

The secondary objectives of the phase 1 dose escalation study with AP1 administered as single agent therapy includes describing the pharmacokinetics (PK) of AP1 and AP1 metabolites in blood samples following single and multiple intravenous (IV) infusions. Potential patient biomarkers (e.g., p53 status, MDM2 and MDMX expression levels), the effect of AP1 treatment on patient biomarkers, and the possible correlation between the biomarkers and clinical response are investigated. The effect of AP1 treatment on potential pharmacodynamic (PD) biomarkers in tumor biopsy samples (including bone marrow aspirates) (e.g., p21, caspase, MDM2) and blood samples (e.g., macrophage inhibitory cytokine-1 [MIC-1]) is determined, and the possible correlation between the biomarkers and clinical response are assessed. The clinical activity and immunogenicity of AP1 are evaluated.

The exploratory objectives of the phase 1 dose escalation study with AP1 administered as single agent therapy includes assessing the effect of AP1 treatment on potential PD biomarkers (e.g., p21, p53, caspase) in circulating tumor cells (CTCs) where detectable, or in mononuclear blood cells (MNCs) starting at dose level 3. The effects of AP1 treatment on cell-free DNA from blood are assessed.

Study Endpoints:

The study endpoints for the phase 1 dose escalation study with AP1 administered as single agent therapy includes safety and tolerability; PK parameters (e.g., area-under-the-curve [AUC], maximum concentration [$C_{max}$], time of $C_{max}$ [$t_{max}$], half-life [$t_{1/2}$]) of AP1 and AP1 metabolites; patient biomarkers (e.g., p53 status, MDM2 and MDMX expression levels), PD biomarkers in tumor biopsy samples (e.g., p21, caspase, MDM2) and in blood samples (e.g., MIC-1); anti-tumor effects; incidence of anti-AP-1 antibodies; and levels of biomarkers (e.g., p21, p53, caspase) in blood, CTCs where detectable, or MNCs pre- and post-treatment with AP1.

b. Phase 2a Dose Escalation Expansion Study in Peripheral T-Cell Lymphoma (PTCL) with AP1 Administered as Single Agent Therapy The primary objectives of the phase 2a dose expansion study are to assess the overall response rate (ORR) of treatment with AP1 and to further evaluate the safety and tolerability of AP1.

The secondary objectives of the phase 2a dose expansion study are to describe the PK of AP1 and metabolites in blood following single and multiple IV infusions in patient populations selected for dose expansion; assess the duration of response (DOR); assess progression free survival (PFS); assess overall survival (OS); assess PFS and OS at 1 year; and assess the time to response. The effect of AP1 treatment on potential PD biomarkers in tumor biopsy samples (including bone marrow aspirates, where clinically indicated) by measuring potential biomarkers (e.g., p53, p21, caspase, MDM2, MDMX) in blood samples is determined by measuring potential biomarkers (e.g., MIC-1). The possible correlation between biomarkers and clinical outcomes is assessed, and the immunogenicity of AP1 is determined.

The exploratory objectives of the phase 2a dose expansion study are to assess the effects of AP1 treatment on cell-free DNA from blood and on potential PD biomarkers (e.g., p21, p53, caspase) in circulating tumor cells where detectable, or in MNCs. The effect of AP1 is assessed using alternative response criteria other than the IWG 2014 or RECIST 1.1 criteria.

Study Endpoints:

The study endpoints for the phase 2a dose expansion study in PTCL with AP1 administered as single agent therapy includes anti-tumor effects of AP1; the safety and tolerability of AP1; PK parameters (e.g., AUC, $C_{max}$, $t_{max}$, and $t_{1/2}$) of AP1 and AP1 metabolites; levels of biomarkers (e.g., p53, MDM2, and MDMX gene sequence and copy number, as well as p21 RNA and/or protein expression) in tumor biopsy samples, and in blood, CTCs where detectable, or MNC samples; and the incidence of anti-AP1 antibodies.

c. Phase 2a Dose Escalation Expansion Study in MDM2 Amplified or MDM2/CDK4 Co-Amplified Solid Tumors Using Combination Treatment with AP1 and Palbociclib.

The primary objectives of the phase 2a dose expansion study are to assess ORR and to evaluate the safety and tolerability of AP1 and palbociclib when administered in combination.

The secondary objectives of the phase 2a dose expansion study are to describe the PK of AP1 and metabolites and palbociclib when administered in combination; to estimate the DOR; and to estimate additional measures of efficacy, including time to response (TRR), PFS, OS, PFS and OS at 1 year. The exploratory objectives of the phase 2a dose expansion study are to explore potential markers of response to treatment with AP1 and palbociclib.

Study Endpoints:

The primary study endpoints for the phase 2a dose expansion study in MDM2 amplified or MDM2/CDK4 co-amplified solid tumors with AP1 and palbociclib include the proportion of efficacy-evaluable patients who receive a complete response (CR) or a partial response (PR) per investigator assessment in accordance with RECIST 1.1 or iRECIST (for solid tumor patients) or Response Assessment in Neuro-Oncology (RANO) criteria (for glioblastoma patients); and the safety and tolerability of AP1 and palbociclib combination treatment, including the occurrence of adverse effects (AEs) and serious adverse effects (SAEs), changes from baseline in vital signs, laboratory analytes, and physical examination findings.

The secondary endpoints for the phase 2a dose expansion study in MDM2 amplified or MDM2/CDK4 co-amplified solid tumors with AP1 and palbociclib includes PK parameters (e.g., AU, $C_{max}$, $t_{max}$, and $t_{1/2}$) for AP1, AP1 metabolites, and palbociclib; and the median time in months from the first response of CR to PR to disease progression or death from any cause (DOR). The secondary endpoint also includes the median time in months for each of the following: the first dose of AP1 to the first response of CR or PR (TTR); the first dose of AP1 to disease progression of death from any cause (measured at 1 year and beyond) (PFS); and the first dose of AP1 to death from any cause (measured at 1 year and beyond) (OS). An exploratory endpoint of the phase 2a study includes the correlation of response with MDM2, MDMX, and/or CDK4 gene copy number and other genetic and protein biomarkers.

Example 24: Study Design of Phase 1/2a Studies

The study is a Phase 1/2a open-label, multi-center, dose-escalation and dose expansion study designed to evaluate the safety, tolerability, PK, PD, and anti-tumor effects of AP1 administered by IV infusion once weekly for 3 consecutive weeks on Days 1, 8, and 15 of a 28-day cycle (Dose Regimen A or DR-A and DR-A-2), twice weekly for 2 consecutive weeks on Days 1, 4, 8, and 11 of a 21-day cycle (Dose Regimen B or DR-B), or three times weekly for one week on Days 1, 3, and 5 of a 21-day cycle (Dose Regimen C or DR-C) in patients with advanced solid tumors or lymphomas that are anticipated to express WT TP53.

The study consists of a Phase 1 Dose Escalation Phase (DEP) and a Phase 2a Dose Expansion Phase (EXP). The DEP is a "3+3" dose escalation design to establish the MTD or the OBD of AP1. The phase 2a EXP enrolls up to 5 distinct groups of patients with specific solid tumors and/or lymphomas to further investigate the clinical safety profile and potential efficacy of AP1 at the MTD, OBD, or in alternate dosing regimens. In the Phase 2a EXP, peripheral T-cell lymphoma (PTCL) is further studied in up to 3 cohorts to identify an optimal dosing regimen.

Another Phase 2a EXP group includes patients with MDM2 amplified or MDM2/CDK4 co-amplified solid tumors who receive AP1 in combination with palbociclib. A safety run-in of 6-8 patients is first enrolled and evaluated before further patients are permitted to enroll in the study. Enrollment of the first 3 patients in the cohort is separated in time by at least one week each, to assess for unexpected acute toxicities related to administration of the treatment regimen. Patients receive AP1 at the recommended Phase 2 dose for the once-weekly administration schedule (3.1 mg/kg on Days 1, 8, and 15) and palbociclib at an oral dose of 100 mg daily for 21 days (one dose level below the approved oral dose of 125 mg) in a 28-day cycle. In the event that this regimen is not determined to be safe or tolerable at these dose levels, the dose of AP1 is decreased by 25% and/or the dose of palbociclib is decreased by one dose level (to 75 mg/day), as needed based on the pattern of toxicities encountered. An additional 6-8 patients are assessed in a safety run-in using the reduced dose level before further patient enrollment is permitted. Subsequent reductions of the AP1 dose by 25% are implemented if safety and tolerability are still not acceptable. Once the safety run-in is complete, all subsequent patients are enrolled at the recommended dose level.

Treatment of patients in the dose escalation and the dose expansion phases of the study are continued until unacceptable toxicity, patient or physician decision to discontinue therapy or disease progression that is either symptomatic, rapidly progressive, requires urgent intervention, or is associated with a decline in performance status.

Starting at Dose Level 4 (DEP), patients with a Human Papilloma Virus (HPV)-positive malignancy are excluded from enrollment. HPV-infected tumor cells continue to express the viral E6 protein, which is known to cause degradation of p53, hence rendering the expected AP1-mediated dual inhibition of MDM2/MDMX unlikely to restore p53 function.

Number of Patients to be Enrolled:

The study enrolls approximately 180 patients. Approximately 75 patients are enrolled in the DEP for treatment with AP1 as single agent therapy, and approximately 20 additional patients for each of the up to five patient groups are enrolled in the EXP. The EXP cohort of patients with MDM2 amplified or MDM2/CDK4 co-amplified solid tumors is enrolls up to 25 efficacy evaluable patients, with approximately 10 patients being MDM2/CDK4 co-amplified. In the event that the distribution of patients with MDM2 amplified versus MDM2/CDK4 co-amplified tumors becomes imbalanced, the sponsor closes enrollment to one group to facilitate enrollment in the other.

Number of Study Sites:

Approximately 15-25 clinical sites are used for the phase 1/2a studies.

Duration of Study:

The expected accrual phase is approximately 54 months. The expected follow-up phase is approximately 8 months after the last patient is enrolled, for a total study duration of approximately 62 months.

Removal of Patients from Study Therapy:

A patient is removed from the study therapy for a variety of reasons, including: disease progression that is symptomatic, rapidly progressive, required urgent intervention, or associated with a decline in performance status; unacceptable adverse event(s); intercurrent illness that prevents further participation; patient refusal to continue treatment through the study and/or consent withdrawal for study participation; the patient being unable or unwilling to comply with study requirements; pregnancy or failure to use adequate birth control; or general or specific changes in the patient's condition that render the patient unacceptable for further treatment in this study in the judgment of the Investigator. Under no circumstance is care of a withdrawn patient adversely affected by a decision to withdraw or be withdrawn from the study.

Patient Replacement:

Any patient who completes screening and does not receive a dose of AP1 (single agent cohorts) or at least one dose each of AP1 and palbociclib (MDM2 amplification and MDM2/CDK4 co-amplification cohort) is replaced. A patient in the dose escalation portion of the study or a safety run in group who discontinues the study prior to completion of the first cycle for reasons other than safety, or who does not receive all required doses in the first cycle, is replaced. A patient in the dose expansion portion of the study who discontinues study participation prior to the completion of the first cycle of treatment for any reason or who does not receive all required doses in the first cycle is replaced. Patients who are not confirmed by the central laboratory to have met all molecular requirements for the designated cohort are replaced.

Example 25: Study Drug Administration

AP1:

AP1 drug product is a frozen or refrigerated liquid product supplied in single-use glass vials in a single dose strength of 75 mg in 5.0 mL, dissolved in 20 mM sodium phosphate, 240 mM trehalose, 300 ppm Polysorbate 20, pH 7.5. Each vial contains recoverable 5.0 mL and is filled with formulated AP1 to 5.5±0.2 mL. AP1 for Injection is stored as frozen product at −15° to −25° C. or refrigerated product at 2° to 8° C.

Palbociclib:

For the Phase 2a cohort with MDM2 amplified or MDM2/CDK4 co-amplified solid tumors, palbociclib is provided to patients as the commercially available product (IBRANCE®, capsules for oral use), and is administered according to the current approved US prescribing information, except as otherwise specified for the protocol.

Palbociclib is administered on an outpatient basis. Patients are provided with a diary to record time of palbociclib administration on each dosing day. In order to assess treatment compliance, the numbers of palbociclib capsules that were dispensed and returned by the patient is recorded. Any dose reductions or interruptions, and the reason for these actions, are also recorded.

Preparation:

AP1 is introduced into an IV infusion bag containing D5W, which is known as AP1 Dosing Solution, and is provided by the site pharmacy for administration to the patient. AP1 Dosing Solution is labeled with the AP1-1-01 Patient Identification Number. The investigative staff confirms this information and the information's relevancy to the intended patient. The start of the AP1 infusion begins within 6 hours of dilution into 250-mL D5W, and the infusion bag remains at room temperature until use.

Patients begin treatment with AP1 within 21 days following the start of clinical screening. Treatment of patients in the dose escalation and the dose expansion phases of the study continues until unacceptable toxicity, patient or physician decision to discontinue therapy, or disease progression that is either symptomatic, rapidly progressive, requires urgent intervention, or is associated with a decline in performance status. Patients receiving clinical benefit despite evidence of suspected or confirmed PD continue on the study after a discussion between the Principle Investigator and Medical Monitor.

AP1 is administered by IV infusion in D5W. The predefined dose is calculated for each patient based on body weight at the start of each cycle. During the first two cycles, AP1 is administered in the morning to allow observation of delayed infusion reactions. AP1 is administered as an IV infusion as follows:

Phase 1 Dose Escalation with AP1 Administered as Single Agent Therapy:

Dose Levels 1 and 2 Dose Regimen A on Days 1, 8, and 15 of each 28-day cycle (1 hour infusion)

Dose Levels 3 and beyond as follows

Dose Regimen A on Days 1, 8, and 15 in a 28-day cycle (1 hour infusion)

Dose Regimen B on Days 1 and 4, 8 and 11 in a 21-day cycle (1 hour infusion)

Dose Regimen A-2 on Days 1, 8, and 15 in a 28-day cycle (2 hour infusion) [starting with Dose Level 7]

Patients who remain on study treatment for 2 years or longer may have the dosing frequency reduced, at the discretion of the investigator (i.e., Days 1 and 15 of a 28-day cycle (DR-A) or Days 1 and 8 of a 21-day cycle (DR-B). In the event that disease control is not maintained, the original dosing schedule is resumed.

Phase 2a Dose Expansion in PTCL with AP1 Administered as Single Agent Therapy:

Dose Regimen A 3.1 mg/kg on Days 1, 8, and 15 in a 28-day cycle (1 hour infusion)

Dose Regimen B 2.7 mg/kg on Days 1 and 4, 8 and 11 in a 21-day cycle (1 hour infusion)

Dose Regimen C 3.1 mg/kg on Days 1, 3 and 5 in a 21-day cycle (1 hour infusion). [If 3.1 mg/kg is not well tolerated, lower doses are tested starting at dose levels of −25%]

Phase 2a Dose Expansion in MDM2 Amplified or MDM2/CDK4 Co-Amplified Solid Tumors with Ap1 and Palbociclib:

AP1: 3.1 mg/kg (1 hour infusion) on Days 1, 8, and 15 in a 28-day cycle plus palbociclib: 100 mg per day orally on Days 1-21 in the same 28-day cycle. It is recommended that palbociclib be administered with food. On days when both drugs are administered (Days 1, 8, and 15 of each cycle), palbociclib is administered at least 6 hours after the infusion of AP1.

Following the administration of each dose of AP1, patients receive 500 to 1000 mL of IV or oral fluids, unless clinically contraindicated.

Example 26: Starting Dose, Dose Escalation, and Dose Reduction

All patients are dosed at a pre-defined level based on body weight as measured on day 1, or up to 3 days prior to the start of the study, of each cycle.

Dose Escalation Criteria (DEP):

In the absence of >33% of patients experiencing a drug-related DLT, escalation to the next dose level for a given treatment arm proceeds when all of the following have occurred: at the completion of Cycle 1 (treatment cycle=28 days for DR-A and DR-A-2 or treatment cycle=21 days for DR-B); the Safety Review Meeting is convened during which the Safety Review Committee (SRC), consisting of the Investigators and Sponsor's Medical Monitor, reviews all available safety data for all patients in the cohort and confirms that the next planned dose level is appropriate; and the Sponsor Medical Monitor issues written documentation of the decision to proceed to the next planned dose level of a dose regimen.

Despite the absence of >33% of patients experiencing a DLT, the next dose level may be less than the planned dose level if the Investigators and Sponsor's Medical Monitor agree that a more conservative dose escalation approach is warranted or would be in the best interest of the patients. The SRC holds the dose (e.g., stop dose escalation) at their discretion and enrolls additional patients until sufficient safety data are obtained to determine escalation of the current dose level or to confirm a certain dose as an MTD or OBD.

a. Phase 1—Dose Escalation

Increasing dose levels of AP1 are evaluated in cohorts of 3-6 DLT-evaluable patients per dose regimen. Patients enrolled in Cohort 1 receive AP1 at Dose Level 1 (0.16 mg/kg). Based on allometric scaling, at 0.16 mg/kg dose in humans, the predicted AUC (50 µg·hr/mL) is approximately 9% of the rat AUC at $STD_{10}$ and approximately 6% of the AUC at the monkey HNSTD. In the absence of DLT in >33% of DLT-evaluable patients in either DR, subsequent cohorts of 3 to 6 patients receive escalated doses until the MTD or an OBD is established for each dose regimen.

Figure 44:
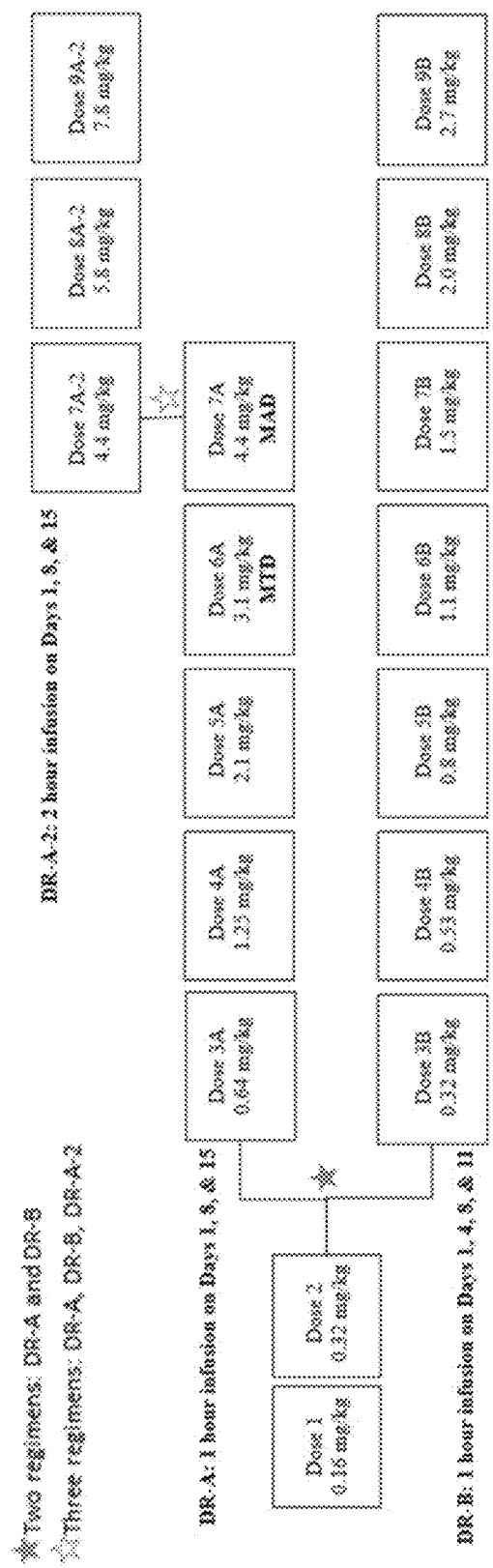
FIG. 44 illustrates the dose level and dose regimen of the phase 1 study.

Starting at Dose Level (DL) 3 in the dose escalation study, patients are sequentially assigned to a treatment arm: Dose Regimen (DR) A continues to test the administration of AP1 once per week, and Dose Regimen (DR) B tests the administration of AP1 twice per week. For Dose Level 3, DR-A is enrolled first, and DR-B is enrolled second. The starting dose (DL1) in DEP, based on results from nonclinical toxicology assessments, is 0.16 mg/kg. FIG. 44 illustrates the dose level and dose regimen of the phase 1 study.

During the first 2 dose levels, patients receive AP1 on Days 1, 8, and 15 of a 28-day cycle. Starting with DL 3, patients in DR-A continue being treated once a week on Days 1, 8, and 15 of a 28-day cycle, whereas patients in DR-B are treated twice a week, on Days 1 and 4, 8 and 11 of a 21-day cycle. Starting at DL 7A, a modified infusion regimen (DR-A-2) is explored to mitigate potential infusion reactions. TABLE 16 compares the treatment regimens of DR-A, DR-A-2, and DR-B.

TABLE 16

| Treatment Regimen | Infusion Days | Infusion Time | Additional notes |
|---|---|---|---|
| DR-A | 1, 8, 15 of a 28-day cycle | 1 hour (±15 min) | At the end of the infusion, IV fluids (saline) or oral fluids (500 mL-1000 mL) should be administered unless clinically contraindicated. |
| DR-A-2 | 1, 8, 15 of a 28-day cycle | 2 hours (±15 min) | At the end of the infusion, IV fluids (saline) or oral fluids (500 mL-1000 mL) should be administered unless clinically contraindicated. Administer dexamethasone (4 mg orally or IV) approximately 4 hours after the end of the infusion in Cycles 1 and 2, and thereafter at the discretion of the investigator. |
| DR-B | 1, 4, 8, 11 for DR-B of a 21-day cycle | 1 hour (±15 min) | At the end of the infusion, IV fluids (saline) or oral fluids (500 mL-1000 mL) should be administered unless clinically contraindicated. |

In DEP, AP1 is not administered outside of the planned schedule in Cycle 1 (i.e., there are no planned windows for dose days). Follow-up visits on non-dosing days have windows, however, at the Investigator's discretion, it may be necessary to conduct a study visit on an alternative day than described in this schedule in order to protect the safety, rights, or welfare of the patient.

Patients in the DEP who remain on study treatment for 2 years or longer may have their dosing frequency reduced (i.e., Days 1 and 15 of a 28-day cycle for DR-A and Days 1 and 8 of a 21-day cycle for DR-B), at the discretion of the investigator. In the event that disease control is lost, the original administration schedule is resumed, at the discretion of the investigator.

A 2-stage dose escalation design is employed. During the initial Stage 1 Escalation Phase, 100% dose increments are utilized until ≥1 of 3 patients in a cohort experiences any Grade ≥2 AE that is at least possibly related to study drug. In Stage 2, dose escalation is continued using 3-patient cohorts and a modified Fibonacci sequence (i.e., 67%, 50%, 40%, 33%), until the MTD or an OBD is established.

A drug-related AE is an event that is possibly, probably or definitely attributed to AP1. Grading of AEs is defined by the NCI Common Terminology Criteria for Adverse Events (CTCAE) version 4.03. As drug-related AEs Grade ≥2 occurred in DL-4A (fatigue) and in DL-3B (neutropenia), subsequent dose escalations with DL-5A and DL-4B are continued using the modified Fibonacci sequence (i.e., 67%, 50%, 40%, and 33%).

Escalation to the next dose level within each DR proceeds in the absence of DLT at the completion of Cycle 1 (treatment cycle=28 days for DR-A, DR-A-2 and 21 days for DR-B). Escalation to the next dose level within each DR as well as the DR and DL for the EXP cohorts is decided by a Safety Review Committee (SRC), consisting of the Principal Investigators and Sponsor's Medical Monitor, which reviews all available safety information from all patients. Two DLTs have occurred in DR-7A (hypotension and hepatobiliary laboratory abnormalities), so there is no further escalation in DR-A. A new modified infusion regimen is tested (DR-A-2) starting at DR-7A-2. Two DLTs have occurred in DR-7A-2 (anemia and neutropenia), so there is no further escalation in DR-A-2.

Based on review of available safety and PK data during studies with AP1, dose escalation or modification steps are adjusted (i.e. increased or decreased) by the SRC to limit the number of patients exposed to sub-therapeutic dose levels and to ensure patients' safety.

The observation of DLT(s) is used to make individual patient determinations regarding dose reductions, interruptions or discontinuation throughout the course of the trial. DLTs occurring during Cycle 1 are used to inform safety and tolerability assessments for dose escalation decisions. If DLTs are observed in the first cohort, the dose is de-escalated to Dose Level −1. If DLTs are observed at Dose Level −1, the dose is de-escalated to Dose Level −2. If DLTs are observed at Dose Level −2, other dose levels are considered and implemented after discussions among the Investigators and Sponsor's Medical Monitor. It is anticipated that at least 3 patients are treated at each dose level per treatment arm. If no patients experience a DLT, then the subsequent 3 patients are treated at the next planned dose level.

Within each Dose Regimen cohort:
If no DLT is observed in a cohort, the subsequent patient group is enrolled at the next planned dose level of that dose regimen.
If a DLT is observed in ≥2 of 3 patients at any dose level, no further dose escalation occurs in that DR, and the current dose is defined as the maximum administered dose (MAD).
If a DLT is observed in 1 of 3 patients in a cohort at any dose level, then up to 6 patients total are enrolled in the same DR at that dose level. If a DLT is observed in 2 or more patients in the expanded cohort, then no further dose escalation occurs, and the current dose is defined as the MAD unless the SRC decides that there is sufficient clinical uncertainty about the DLTs that warrants the enrollment of up to 6 additional patients. In the event of additionally enrolled patients, if a DLT is observed in 33% or more DLT-evaluable patients in the entire cohort, then no further dose escalation occurs, and the current dose is defined as the MAD for the dosing regimen under consideration.
After the MAD is defined, either the previously administered lower dose is expanded to a total of 6 patients, or an intermediate dose (between the MAD and the previous dose level) is investigated in a total of 6 patients. The highest dose tolerated in at least 5 of 6 patients (i.e. <33% of DLT-evaluable patients experiencing a DLT) is defined as the MTD or OBD. Additional patients are added to further explore the MTD or OBD prior to expansion.

Based on review of available safety and PK data during studies with AP1, dose escalation or modification steps are adjusted (i.e. increased or decreased) by the SRC to limit the number of patients exposed to sub-therapeutic dose levels as well as to ensure patients' safety. Additional patients are added to further explore safety at a dose level or to confirm a certain dose as an MTD or OBD.

Intra-Patient Dose Escalation:

A patient's dose can be increased to that of a cohort that completed the first cycle without dose-limiting toxicity in ≥33% of DLT-evaluable patients and that does not exceeded the MTD. Intra-patient dose escalations are allowed provided that the patient completed at least two treatment cycles and does not experience study medication-related toxicity greater than Grade 2 (except for alopecia, electrolyte disturbances responsive to correction within 24 hours, diarrhea, nausea, fatigue and vomiting that responds to standard medical care). Approval for intra-patient dose escalation is obtained from the Medical Monitor.

Dose Modifications:

In the event a Grade 4 AE considered related to AP1 is observed, the patient is discontinued from the study. Exceptions include Grade 4 neutropenia lasting <3 days, and emesis, diarrhea or electrolyte abnormalities that resolve within 2 days on optimum treatment. For these exceptions, treatment is delayed for up to 2 weeks to allow resolution of the toxicity (i.e., return to Grade ≤1 or baseline), followed by re-treatment at a reduced dose. Two dose reductions are permitted, and a third dose reduction requires evidence of clinical benefit and approval by the Medical Monitor. Relevant labs are repeated as medically indicated. For dose modifications for re-treatment following related Grade 3 and Grade 4 AEs (as permitted), patients are re-treated at the preceding dose level.

In the event a Grade 3 AE considered related to AP1 is observed (exceptions are Grade 3 fatigue, nausea, emesis, diarrhea or clinically insignificant electrolyte abnormalities that resolve within 2 days on optimum treatment), treatment is delayed for up to 2 weeks to allow resolution of the toxicity, followed by re-treatment at a reduced dose. Two dose reductions are permitted, and a third dose reduction requires evidence of clinical benefit and approval by the Medical Monitor. Relevant labs are repeated as medically indicated.

For other clinically significant AEs, treatment is delayed by up to 2 weeks to allow for the resolution of AEs to an acceptable level, and treatment is continued at a reduced dose level at the discretion of the Investigator in consultation with Sponsor's Medical Monitor. If a patient experiences multiple AEs, decisions on dosing delay or dose reduction are based on the most severe AE. Any patient who experiences recurrent, clinically significant AE after one dose reduction undergoes one additional dose reduction. Patients who continue to experience clinically significant AEs after a 2-week delay or the maximum allowed number of dose reductions are discontinued from the study.

Adverse events considered for dose reduction do not include events assessed by the Investigator as exclusively related to underlying disease or other medical condition or concomitant treatment. A patient who experiences an AE considered related to AP1 that does not meet the requirement for discontinuation continues on the study if the patient is receiving clinical benefit and/or the Investigator feels continued participation is in the best interest of the patient. In such cases, at the Investigator's discretion and in agreement with Sponsor's Medical Monitor, the dose for a patient is reduced as described above.

A patient who experiences a DLT continues treatment at a reduced dose level, or discontinues AP1 treatment (if Grade 4 related AE), as described above at the discretion of the Investigator and in agreement with Sponsor's Medical Monitor until disease progression or unacceptable toxicity. Once the dose is reduced for a patient, it is not be re-escalated.

Following related Grade 3 and Grade 4 AEs (as permitted), the dose for re-treatment is reduced by 25% intervals (e.g., if the dose is 3.1 mg/kg, the dose is reduced sequentially to 2.3 mg/kg and 1.7 mg/kg).

For other clinically significant AEs, treatment is delayed by up to 2 weeks to allow for the resolution of AEs to an acceptable level, and a dose reduction is made as described above at the discretion of the Investigator in consultation with Sponsor's Medical Monitor. If a patient experiences multiple AEs, decisions on dosing delay or dose reduction are based on the most severe AE. Any patient who experiences recurrent, clinically significant AEs after one dose reduction undergoes one additional dose reduction. Patients who continue to experience clinically significant AEs after a 2-week delay or the maximum allowed number of dose reductions are discontinued from the study.

Dose Limiting Toxicity Definition During Phase 1 Dose Escalation:

A DLT is defined as any Grade ≥3 AE that is considered possibly, probably, or definitely related to the study drug, with the following exceptions: (1) for fatigue, nausea, emesis, diarrhea or mucositis, only Grade ≥3 AE that do not respond within 48 hours to standard supportive/pharmacological treatment are considered DLT; (2) for electrolyte imbalances, only Grade ≥3 AE that do not respond to correction within 24 hours are considered DLT; (3) for infusion reactions, only a Grade 3 reaction which caused hospitalization or Grade 4 are considered DLT. In addition, specific hematologic DLTs are defined as: thrombocytopenia—Grade 4 of any duration, Grade 3 for ≥7 days, or Grade 3 associated with clinically significant bleeding; and Neutropenia—Grade 4 for ≥3 days, or any Grade ≥3 febrile neutropenia. The above criteria are used to make individual patient determinations regarding dose reductions, interruptions or discontinuation throughout the course of the trial, but DLTs occurring during Cycle 1 are used to inform safety and tolerability assessments for dose escalation decisions.

b. Phase 2a Dose Expansions

The EXP enrolls up to 5 distinct groups of patients with specific solid tumors and/or lymphomas to further investigate the clinical safety profile and potential efficacy of AP1 at the MTD, OBD, or an alternative dosing regimen. PTCL has been selected as one of the EXP groups to be further studied; up to 3 cohorts in PTCL are studied in order to determine the optimal dosing regimen. Another Phase 2a EXP group includes patients with MDM2 amplified or MDM2/CDK4 co-amplified solid tumors who receive AP1 in combination with palbociclib.

Based on the safety, efficacy and PK/PD profile of AP1 from the dose escalation portion of the study and data from other clinical trials and preclinical data, three dosing regimens of AP1 are administered as single agent therapy (DR-A, DR-B, DR-C) and tested in Phase 2a EXP in PTCL to determine the optimal dosing regimen.

For patients with MDM2 amplified or MDM2/CDK4 co-amplified solid tumors, patients receive AP1 in combination with palbociclib. Palbociclib is administered at an oral dose of 100 mg daily (Days 1-21) in combination with AP1, which is administered at 3.1 mg/kg on Days 1, 8, and 15 of a 28-day cycle (or as otherwise determined during the safety run-in period for this cohort).

The decision to begin palbociclib below the approved dose level of 125 mg is based on the frequency of required dose reductions, often due to neutropenia. The SRC escalates the dose to the approved palbociclib dose if palbociclib-related toxicities are not being encountered and patient benefit is expected to outweigh risk.

TABLE 17

| Treatment Regimen | Drug and Dose Level | Infusion Days | Infusion Time | Additional notes |
|---|---|---|---|---|
| DR-A | AP1 3.1 mg/kg | 1, 8, 15 of a 28-day cycle | 1 hour (±15 min) | At the end of the infusion, IV fluids (saline) or oral fluids (500 mL-1000 mL) are administered. |
| DR-B | AP1 2.7 mg/kg | 1, 4, 8, 11 of a 21-day cycle | 1 hour (±15 min) | At the end of the infusion, IV fluids (saline) or oral fluids (500 mL-1000 mL) are administered. |
| DR-C | AP1 3.1 mg/kg [If 3.1 mg/kg is not well tolerated, lower doses may be tested starting at dose levels of −25%] | 1, 3, 5 of a 21-day cycle | 1 hour (±15 min) | At the end of the infusion, IV fluids (saline) or oral fluids (500 mL-1000 mL) are administered. |
| Combination with palbociclib | AP1 3.1 mg/kg [If 3.1 mg/kg is not well tolerated, up to two dose reductions of 25% may be tested] | 1, 8, 15 of a 28-day cycle | 1 hour (±15 min) | At the end of the infusion, IV fluids (saline) or oral fluids (500 mL-1000 mL) are administered, unless clinically contraindicated. |
| | Palbociclib 100 mg [If 100 mg is not well tolerated, a reduced dose of 75 mg may be tested.] | 1-21 of a 28-day cycle | Oral | Palbociclib should be administered with food. On days when both drugs are administered (Days 1, 8, and 15 of each cycle), palbociclib is administered at least 6 hours after the infusion of AP1. |

Dose Levels and Modifications for Phase 2a Dose Expansions in PTCL with AP1 Administered as Single Agent Therapy:

Two DLTs were observed at DL-7A (hypotension and hepatobiliary laboratory abnormalities) rendering DL-7A the maximum administered dose whereas in DL-6A, only one DLT was observed (fatigue) in six DLT-evaluable patients. Furthermore, a complete remission has been observed in a PTCL patient at DL-5A (2.1 mg/kg). Therefore, the first selected dose and schedule for the Phase 2a expansion in PTCL is 3.1 mg/kg on Days 1, 8, and 15 of a 28 day cycle (DL-6A). Alternative dosing regimens to be tested include 2.7 mg/kg on Days 1, 4, 8, and 11 of a 21 day cycle (DR-B) and 3.1 mg/kg on Days 1, 3, and 5 of a 21 day cycle (DR-C). Six to 8 patients are enrolled in DR-C in a run-in part and the treating investigators, along with the Medical Monitor, reviews safety and tolerability through Cycle 1 prior to opening the full DR-C expansion cohort. Lower dose levels for DR-C, in 25% reductions in the starting dose, are assessed if the safety and tolerability of 3.1 mg/kg are not acceptable. Should this occur, 6-8 patients are again be enrolled into a run-in part and the treating investigators and Medical Monitor meets again to review all patients prior to opening the full DR-C expansion cohort. For each dose level assessed during the run-in part, the SRC uses the DLTs defined in Phase 1 as a guide for determining safety.

Dose Modifications:

In the event a non-hematologic Grade 4 AEs considered related to AP1 is observed, the patient is discontinued from the study. Exceptions include emesis, diarrhea or electrolyte abnormalities that resolve within 2 days on optimum treatment. For these exceptions, treatment is delayed for up to 2 weeks to allow resolution of the toxicity (i.e., return to Grade ≤1 or baseline), followed by re-treatment at a reduced dose. Relevant labs are repeated as medically indicated.

In the event a non-hematologic Grade 3 AE considered related to AP1 is observed (exceptions are Grade 3 fatigue, nausea, emesis, diarrhea or clinically insignificant electrolyte abnormalities that resolve within 2 days on optimum treatment), treatment is delayed for up to 2 weeks to allow resolution of the toxicity, followed by re-treatment at a reduced dose. Relevant labs are repeated as medically indicated.

For hematologic toxicities, patients discontinue treatment with AP1 if: neutrophil counts <0.5×10$^9$/L for >5 days; platelet counts <10×10$^9$/L; or hemoglobin <6 g/dL (despite RBC transfusion or ESA administration). Patients interrupt treatment if: neutrophil counts <0.5×10$^9$/L for ≤5 days; platelet counts <25×10$^9$/L and >10×10$^9$/L; or hemoglobin <8 g/dL and >6 g/dL. After resolution of hematologic toxicity (i.e., return to Grade ≤1 or baseline), patients continue treatment at a reduced dose. Relevant labs are repeated as medically indicated.

Following related Grade 3 and Grade 4 AEs (as permitted), the dose for re-treatment is reduced by 25% intervals (e.g., if the dose is 3.1 mg/kg, the dose is reduced sequentially to 2.3 mg/kg and 1.7 mg/kg). Two dose reductions are permitted, and a third dose reduction requires evidence of clinical benefit and approval by the Medical Monitor.

Dose Levels and Modifications for Phase 2a Dose Expansion in MDM2 Amplified or MDM2/CDK4 Co-Amplified Solid Tumors with AP1 and Palbociclib:

A safety run-in group of 6-8 patients is first enrolled and evaluated by the sponsor and the primary investigators before further patients are permitted to enroll in the study. The SRC uses the DLTs defined in Phase 1 and the toxicity profile of palbociclib (in accordance with the package insert) as a guide for assessing safety.

Enrollment of the first 3 patients in the cohort is separated in time by at least one week each, to assess for unexpected acute toxicities related to administration of the treatment regimen. AP1 is administered by IV infusion over 1 hour (+15 min) on Days 1, 8, and 15 of a 28-day cycle. Palbociclib is administered at an oral dose of 100 mg daily for 21 days (one dose level below the approved oral dose of 125 mg) in the same 28-day cycle. A safety run-in group of 6-8 patients is first enrolled and evaluated before further patients are permitted to enroll. In the event that this regimen is not determined to be safe or tolerable at these dose levels, the dose of AP1 is decreased by 25% and/or the dose of palbociclib is decreased by one dose level (to 75 mg/day), as needed based on the pattern of toxicities encountered. An additional 6-8 patients are assessed in a safety run-in using the reduced dose level before further enrollment is permitted. One subsequent reduction of the AP1 dose by 25% is implemented if safety and tolerability are still not acceptable. Once the safety run-in is complete, all subsequent patients are enrolled at the recommended dose level.

Dose Modifications:

Dose modifications of AP1 are as described above for the Phase 1 dose escalation. Dose modifications of palbociclib are made in accordance with the current approved US prescribing information. In the event that palbociclib administration must be discontinued, the patient continues to receive AP1 as a study participant until a criterion for treatment discontinuation has been met. However, if discontinuation of AP1 is required, patients are considered to have discontinued study treatment. These patients continue to receive palbociclib treatment at the investigator's discretion.

Example 28: TP53 Status Determination and Tumor Sampling Requirements

A central laboratory is employed to test archived tumor tissue samples or fresh biopsy samples from all patients enrolled in the study for TP53 status using Next-Generation Sequencing (NGS). A fresh biopsy sample is not obtained if such biopsy poses a significant clinical risk to the patient. To minimize the potential risks from biopsies, the healthcare professional performing the biopsy ensures that any biopsy performed uses a tumor location that presents a non-significant risk to the patient. The healthcare professional performing the biopsy chooses the biopsy procedure that poses the lowest risk to the patient. Examples of significant risk procedures include (but are not limited to) surgical biopsies of the brain, lung/mediastinum or pancreas.

Starting at DEP Dose Level 4, only patients with tumors WT TP53 are enrolled in the study because AP1 requires WT p53 protein to be pharmacologically active. Some tumor cells harbor a TP53 mutation on one allele, while maintaining WT TP53 on the second allele for TP53 to be pharmacologically active. AP1 potency has been demonstrated in a cell line with one WT TP53 allele and one mutated allele, in a substantial percentage of cells examined.

In EXP, exceptions from the requirement to obtain central laboratory confirmation of WT p53 status prior to enrollment are included in the study. The tumor types to be studied during the expansion phase of this clinical trial are among those with high rates of WT TP53, thus enrollment of patients with mutant or deleted TP53 are rare. Removal of the requirement to await central laboratory results allows patients with an urgent need for treatment to participate in the study without enduring the two week delay that occurs while central laboratory testing is performed. Central laboratory testing is required to confirm WT p53 status.

In the Phase 2a EXP PTCL cohorts, optional biopsies are taken for PD purposes and TP53 testing during screening, in Cycle 1 or 2, and at times of suspected and/or confirmed progression. In the palbociclib combination cohort, if a biopsy is taken for any reason during the study, the samples are used for further analysis.

a. Phase 1 Dose Escalation

In the DEP, patients meet the TP53 requirement through one of the following scenarios (per the exception to exclusion criterion 1, patients previously treated with an MDM2-inhibitor are also eligible, provided that a biopsy taken after completion of the last treatment with an MDM2-inhibitor meets one of the following): 1) Patients are eligible based on a fresh biopsy or archived tissue that is ≤1 year old. All samples are tested for TP53 status using NGS at the central laboratory. The central laboratory determines the TP53 status as expeditiously as possible. 2) Upon approval from the medical monitor, patients enroll and initiate study treatment based on wildtype TP53 status that was determined by another laboratory. The testing must be performed on tumor samples obtained no more than one year ago. These archived specimens with previously determined TP53 status are still be submitted for NGS testing at the central laboratory; the central laboratory's result determines the patient's official classification as either TP53 wildtype or TP53 mutant. Patients who do not have archived tissue, and for whom a biopsy poses a significant risk, are not enrolled in the study.

In DEP, patients who satisfy all inclusion and exclusion criteria are enrolled in cohorts of 3 to 6 patients to receive AP1. AP1 is administered by IV infusion in Dose Regimen A over 1 hour (±15 min) on Days 1, 8 and 15 of a 28-day cycle, over 2 hours (±15 min) on Days 1, 8 and 15 of a 28-day cycle in Dose Regimen A-2 starting at Dose Level 7, or in Dose Regimen B over 1 hour (±15 min), starting at Dose Level 3, on Days 1, 4, 8, and 11 of a 21-day cycle. Patients who remain on study treatment for 2 years or longer have their dosing frequency reduced, at the discretion of the investigator (i.e., Days 1 and 15 of a 28-day cycle (DR-A) or Days 1 and 8 of a 21-day cycle (DR-B). In the event that disease control is not maintained, the original dosing schedule is resumed.

After the MTD or OBD is established for a particular dosing regimen, additional patients are enrolled in up to 5 expansion cohorts (approximately 20 patients per expansion cohort) to gain further experience in particular patient or tumor types or to test alternative dosing regimens. A selection of patient or tumor types is determined in part on the basis of observations made in the dose escalation portion of the study.

b. Phase 2a Dose Expansion

In the Phase 2a EXP in PTCL, patients meet the TP53 requirement through one of the following scenarios: 1) Patients are tested for TP53 status using a fresh biopsy or archived tissue that is ≤1 year old. Archived tissue is used only if the patient did not receive systemic cytotoxic therapy in the interval between tissue collection and the start of treatment with study medication. All samples are tested for TP53 status using NGS at the central laboratory. The central laboratory determines the TP53 status as expeditiously as possible. Investigators are encouraged to await the TP53 test result, however, if this is clinically deemed not to be in the patient's best interest, enrollment and the initiation of study treatment proceeds prior to the central laboratory result becoming available. Central laboratory testing is required to confirm WT p53 status. 2) Upon approval from the medical monitor, patients enroll and initiate study treatment based on wildtype TP53 status that is determined by another laboratory. Testing is performed on tumor samples obtained no more than one year ago, and the patient must not have received systemic cytotoxic therapy in the interval since the tissue was obtained. These archived specimens with previously determined TP53 status are still submitted for NGS testing at the central laboratory; the central laboratory's result determines the patient's official classification as either TP53 wildtype or TP53 mutant. Patients who do not have archived tissue, and for whom a biopsy poses a significant risk, are not enrolled in the study.

AP1 is administered by IV infusion in Dose Regimen A over 1 hour (+15 min) on Days 1, 8 and 15 of a 28-day cycle, in Dose Regimen B over 1 hour (±15 min) on Days 1, 4, 8, and 11 of a 21-day cycle, and in Dose Regimen C over 1 hour (+15 min) on Days 1, 3, and 5 of a 21-day cycle. For the Dose Regimen C cohort, 6-8 patients are enrolled in a safety run-in part and the treating investigators, along with the Medical Monitor, reviews safety and tolerability through Cycle 1 prior to opening the full DR-C expansion cohort.

In the Phase 2a EXP cohort in MDM2 amplified or MDM2/CDK4 co-amplified solid tumors (AP1 plus palbociclib): 1) Patients must have MDM2 amplified or MDM2/CDK4 co-amplified solid tumors as determined by NGS, fluorescent in situ hybridization (FISH) or comparative genomic hybridization (CGH). Enrollment is based on alternative (e.g., local or commercial) testing of MDM2 and CDK4 status following approval by the Medical Monitor; however, all patients have fresh or archival tissue submitted to the central laboratory for NGS testing. The central laboratory's results determine the patient's official classification as MDM2 amplified, MDM2/CDK4 co-amplified, or neither MDM2 amplified nor MDM2/CDK4 co-amplified. 2) Mutational analysis of TP53 is not required for the cohort because TP53 mutations are extremely rare among patients with MDM2 amplifications. However, patients with known mutations or deletions of TP53 are excluded from study participation. Patients with known retinoblastoma protein (Rb) mutations are also excluded from the study.

Safety in Phase 1 and 2a:

Safety is evaluated based on the incidence, severity, duration, causality, seriousness, type of AE, and changes in the patient's physical examination, vital signs, and clinical laboratory results. Investigators use the NCI CTCAE version 4.03 to assess the severity of AEs. The immunogenicity of AP1 is assessed by measuring anti-AP1 antibodies. If the safety profile appears favorable, the study is amended in the future to expand existing cohorts or subsets of existing cohorts, add cohorts to test additional cancer types, or add cohorts to test other combination treatments with AP1.

Example 29: Pharmacokinetic, Pharmacodynamic, and Clinical Activity Assessments

Blood samples are collected after single and multiple infusions for PK analysis of AP1 and metabolites to correlate clinical responses with exposure levels and assess inter-individual variability. Patients receiving AP1 in combination with palbociclib have additional blood samples collected for determination of PK parameters for palbociclib.

Levels of p53 and its endogenous inhibitors MDM2 and MDMX are assessed before and after exposure to AP1, and the possible correlation between biomarkers and outcome or response are investigated. In the cohort of patients with MDM2 amplified or MDM2/CDK4 co-amplified solid tumors, the correlation of response with MDM2, MDMX, and/or CDK4 gene copy number and other genetic and protein biomarkers are investigated.

Pharmacodynamics are assessed by laboratory-based evaluation of several biomarkers of p53 activation, including levels of p21, caspase, and MDM2 in tumor tissue, and where available in CTC, or MNC, as well as MIC-1 in blood, before and after treatment with AP1. Pharmacodynamic effects on the composition of cell-free DNA from blood are evaluated.

Results available from previous genetic and biomarker tests, and additional tests of the blood and tumor samples for biomarkers relevant to the safety and efficacy of AP1 or AP1+palbociclib are investigated for possible correlation with patient outcomes. Any remaining samples collected for PK, biomarker assays, and immunogenicity are used for exploratory biomarker profiling, sample identification, or additional safety assessments (e.g., anti-drug antibody characterization) as appropriate. For any cohort that includes adolescents, an assessment of pharmacologic differences between adolescents and adults are performed.

a. Phase 1 Dose Escalation

Clinical Activity:

Clinical activity or response is evaluated by standard imaging assessments, such as computed tomography (CT), magnetic resonance imaging (MRI), and bone scans. In addition, [$^{18}$F]-fluorodeoxyglucose positron emission tomography (FDG-PET) or other techniques considered clinically appropriate for the patient's specific disease type are used. Anti-tumor activity is assessed using RECIST 1.1 for patients with solid tumors or using IWG (2014) criteria for patients with lymphomas. The same imaging technique is used at each assessment for a patient.

Positron Emission Tomography (PET) Scans:

For patients with an FDG-avid lymphoma, FDG-PET imaging is performed at baseline and post-baseline as outlined in IWG 2014 during DEP and in the EXP. For solid tumor patients, FDG-PET imaging is performed at baseline and subsequently post-dose at the first occurrence of stable disease in applicable patients as an adjunct to determine anti-tumor activity, as outlined in RECIST 1.1. Applicable patients are those who had an evaluable FDG-PET-scan performed prior to starting treatment with study drug. PET/CT scans are used as a substitute for contrast-enhanced CT scans provided the CT performed as part of a PET-CT is of similar diagnostic quality as a diagnostic CT with IV and oral contrast. As with CT-imaging, the same imaging technique is used for each patient's PET assessment.

b. Phase 2a Dose Expansion

Biopsies:

In the Phase 2a EXP PTCL cohorts, optional biopsies are taken for PD and p53 status determination purposes: one during screening, one during treatment, and one or more at times of suspected and/or confirmed progression. In the palbociclib combination cohort, if a biopsy is taken for any reason during the study, the samples are used for further analysis. Samples are submitted for whole exome sequencing (with a paired germline sample) and RNA sequencing (RNAseq), and the results are compared between pre-treatment and on-treatment, and time of suspected and/or confirmed progression tumor samples for markers of disease response and resistance. Protein expression via immunohistochemistry and RNA expression via quantitative RT-PCR are examined on specimens obtained prior to beginning treatment, during treatment with AP1, and then upon suspected and/or confirmed progression.

Clinical Activity:

Clinical activity or response is evaluated by standard imaging assessments, such as CT, FDG-PET, or other techniques considered clinically appropriate for the patient's specific disease type. Anti-tumor activity is assessed using RECIST 1.1 for patients with solid tumors, Response Assessment in Neuro-Oncology [RANO] for glioblastoma, or IWG (2014) criteria for patients with lymphomas. The application of additional assessment techniques is also considered, as appropriate, throughout the conduct of the study. For patients enrolled to the Phase 2a expansion cohort of patients with MDM2 amplified or MDM2/CDK4 co-amplified solid tumors, iRECIST is included in methods of assessing clinical activity. The same evaluation techniques are used at each assessment for a patient.

For patients with an FDG-avid lymphoma, FDG-PET imaging is performed at baseline and post-baseline as outlined in IWG 2014. PET/CT scans are used as substitutes for contrast-enhanced CT scans provided the CT performed as part of a PET-CT is of similar diagnostic quality as a diagnostic CT with IV and oral contrast. As with CT-imaging, the same imaging technique is used for each patient's PET assessment.

Example 29: Inclusion and Exclusion Criteria a. Phase 1 Dose Escalation Study with AP1 Administered as Single Agent Therapy Inclusion Criteria:

Patients must meet all of the following criteria to be considered for participation in the study.

1. Male or female patients age 18 years and older, inclusive, at the time of informed consent.
2. Histologically or cytologically confirmed solid tumors that are metastatic or unresectable or lymphomas. Standard measures do not exist or are no longer effective for these patients.
3. WT TP53 status for relapsing or treatment-refractory solid neoplasms and lymphomas is mandatory for patients enrolling at Dose Level 4 and higher in Stage 1 of the DEP, as well as for all patients enrolled in Stage 2 of the DEP or in the EXP. In EXP, TP53 status still must be determined by the central laboratory, but confirmation of WT TP53 status is not required for enrollment or initiation of study treatment, if the Investigator deems it clinically unacceptable to delay treatment.
4. At least one target lesion that is measurable by either Response Evaluation Criteria in Solid Tumors (RECIST 1.1) or by Revised International Working Group Response Criteria for lymphoma patients (IWG 2014).
5. Eastern Cooperative Oncology Group (ECOG) performance status 0-1.
6. Predicted life expectancy of ≥3 months.
7. Adequate hematologic bone marrow function, measured within 7 days prior to the first dose of AP1, defined as: Absolute neutrophil count (ANC) ≥1.5×10$^9$/L; Hemoglobin ≥9.0 g/dL; and Platelets ≥100×10$^9$/L.
8. Adequate hepatic function, measured within 7 days prior to the first dose of AP1, defined as: In the absence of disease involvement of the liver: bilirubin ≤1.5 times institutional upper limit of normal (ULN), as well as aspartate aminotransferase (AST) and alanine aminotransferase (ALT) ≤2.5 times ULN; and in the presence of disease involvement of the liver: bilirubin ≤2 times institutional ULN as well as AST and ALT ≤5 times ULN.
9. Adequate renal function, measured within 7 days prior to the first dose of AP1, defined as: Urinalysis with no evidence of +2 or higher proteinuria; and Serum creatinine ≤1.5 times institutional ULN, or calculated creatinine clearance ≥50 mL/min (Cockcroft-Gault formula).
10. Acceptable coagulation profile, measured within 7 days prior to the first dose of AP1, defined as: Prothrombin time (PT) or international normalized ratio (INR) ≤1.5 times ULN; and Activated partial thromboplastin time (aPTT)≤1.5 times ULN.

11. Prior anti-cancer therapies must wash-out such that they can neither cause drug-drug interaction with AP1 nor interfere with the anti-cancer evaluation of AP1. Therefore, the wash-out has to meet all the following criteria: 1) patients must have recovered from the previous therapy to Grade 1 or baseline of significant toxicities, excluding alopecia; and 2) 5 half-lives or 4 weeks (whichever is shorter) must have expired, unless the prior anti-cancer therapy and AP1 do not interfere with each other's metabolism; and 3) 5 half-lives or 4 weeks (whichever is shorter) must have expired, unless the patient unequivocally progressed during the prior anti-cancer therapy. Palliative radiotherapy for bone lesions ≤2 weeks prior to the first dose of AP1 is acceptable if acute toxicity has resolved.

12. Negative serum or urine pregnancy test within 2 days prior to the first dose of AP1 for women of child-bearing potential, defined as a sexually mature woman who has not undergone a hysterectomy or who has not been naturally post-menopausal for ≥24 consecutive months (i.e., who has had menses any time in the preceding 24 consecutive months).

13. All patients (males and females) of child-bearing potential must agree to use an effective method of birth control (i.e., latex condom, diaphragm, cervical cap, intra-uterine device [IUD], birth control pill, etc.) beginning two weeks prior to the first dose of AP1 and for 30 days after the last dose of AP1.

14. Ability to understand and willingness to sign a written informed consent form.

15. Patients with prostate cancer must continue androgen deprivation therapy, unless such therapy was discontinued 6 months prior to first dose of AP1.

Exclusion Criteria:

Patients who meet any of the following criteria at screening or Day −1 are excluded from the study:

1. Previous treatment with investigational agents that inhibit MDM2 or MDMX activity with the following exception: Patients previously treated with an MDM2-inhibitor are eligible provided that a biopsy taken after completion of the last treatment with an MDM2-inhibitor is confirmed as WT TP53 prior to enrollment.
2. Known hypersensitivity to any study drug component.
3. Known and untreated brain metastases. Patients with brain metastases that have been treated and demonstrated to be clinically stable for ≥30 days may be enrolled. Patients with primary central nervous system (CNS) malignancies are excluded.
4. Current, clinically significant coagulopathy or platelet disorder, as determined by the Investigator
5. History of pulmonary embolism within 6 months prior to the first dose of AP1 or untreated deep venous thrombosis (DVT).
6. Required concurrent use of anti-coagulants or anti-platelet medication, with the exception of aspirin doses ≤81 mg/day, low-dose subcutaneous (SC) heparin or SC low-molecular-weight heparin for DVT prophylaxis, or heparin flushes to maintain IV catheter patency.
7. Patients with pre-existing history of or known cardiovascular risk: History of acute coronary syndromes within 6 months prior to the first dose of AP1 (including myocardial infarction, unstable angina, coronary artery bypass graft, angioplasty, or stenting); Uncontrolled hypertension; Pre-existing cardiac failure (New York Heart Association Class III-IV); Atrial fibrillation on anti-coagulants; Clinically significant uncontrolled arrhythmias; Severe valvulopathy; or Corrected QT (QTc) interval on screening electrocardiogram (ECG) ≥450 msec for males and ≥470 msec for females (QTc≥480 msec for any patient with a bundle branch block).
8. Clinically significant gastrointestinal bleeding within 6 months prior to the first dose of AP1.
9. Clinically significant third-space fluid accumulation (e.g., ascites requiring tapping despite the use of diuretics; or pleural effusion that requires tapping or is associated with shortness of breath)
10. Pregnant or lactating females
11. Evidence of serious and/or unstable pre-existing medical, psychiatric, or other condition (including laboratory abnormalities) that could interfere with patient safety or provision of informed consent to participate in this study
12. Active uncontrolled infection including HIV/AIDS or Hepatitis B or C. Patients with primary liver cancer that have positive hepatitis serology but are not demonstrating active viral hepatitis may be considered for enrollment if they meet all other inclusion and no other exclusion criteria.
13. Starting at Dose Level 4 and higher in Stage 1 of the DEP (as well as for all patients enrolling in Stage 2 of the DEP or in the EXP), patients with an Human Papilloma Virus (HPV)-positive malignancy.
14. Known history of another primary malignancy that has not been in remission for ≥2 years. Non-melanoma skin cancer and cervical carcinomas in situ or squamous intra-epithelial lesions (e.g., cervical intraepithelial neoplasia [CIN] or prostatic intraepithelial/intraductal neoplasia [PIN]) are allowed.
15. Any psychological, sociological, or geographical condition that could potentially interfere with compliance with the study protocol and follow-up schedule.
16. The required use of any concomitant medications that are predominantly cleared by hepatobiliary transporters, organic anion transporter polypeptide [OATP] members OATP1B1 and OATP1B3, on the day of the infusion AP1 or within 48 hours after an AP1 infusion.
17. Hereditary angioedema of any severity or history of severe or life-threatening angioedema due to any cause.

b. Phase 2a Dose Expansion in PTCL with AP1 Administered as Single Agent Therapy Inclusion Criteria:

Patients must meet all of the following criteria to be considered for participation in this study:

1. Male or female patients age 18 years and older at the time of informed consent.
2. A histologically confirmed diagnosis of PTCL based on pathology review at the local institution, using the most recent edition of the WHO Classification of Tumors of Haematopoietic and Lymphoid Tissues as guidance. The pathology sample must be considered to be adequate, meaning that there must be enough well-preserved, formalin-fixed biopsy material for the pathologist to be able to perform a morphological and immunohistochemical examination so as to in confidence be able to state an unequivocal diagnosis of PTCL. Final diagnoses containing caveats such as "suspicious of" or "presumably" are considered inadequate for a patient to be enrolled in the trial. In addition, a pathology sample must be available for a potential central pathology read.
3. Patients must have relapsed or refractory disease after at least one but not more than 7 prior systemic anticancer regimen.
4. Wildtype TP53 status of T-cell lymphoma cells: TP53 status must be determined by the central laboratory, but confirmation of WT TP53 status is not required for enrollment or initiation of study treatment, if the Investigator deems it clinically unacceptable to delay treatment.

5. At least one target lesion that is measurable by Revised International Working Group Response Criteria for lymphoma patients (IWG 2014). Patients with PTCL subtypes that are assessed by alternative criteria must have measurable disease in accordance with those criteria and be approved by the Medical Monitor.

6. Eastern Cooperative Oncology Group (ECOG) performance status 0-1.

7. Predicted life expectancy of ≥3 months.

8. Adequate hematological bone marrow function, measured within 7 days prior to the first dose of AP1, defined as: Absolute neutrophil count (ANC) ≥1.0×10$^9$/L; and Platelets ≥50×10$^9$/L (platelets <50×10$^9$/L are acceptable if partly caused by autoimmune destruction and/or splenomegaly and/or hepatic disease infiltration)

9. Adequate hepatic function, measured within 7 days prior to the first dose of AP1, defined as: Total bilirubin ≤1.5× upper normal limit, or ≤3× upper normal limit if documented hepatic infiltration with lymphoma; and Aspartate aminotransferase (AST) and alanine aminotransferase (ALT) ≤2.5× upper normal limit (≤5× upper normal limit if documented hepatic infiltration with lymphoma).

10. Adequate renal function, measured within 7 days prior to the first dose of AP1, defined as serum creatinine ≤1.5 times institutional ULN, or calculated creatinine clearance ≥50 mL/min (Cockcroft-Gault formula).

11. Acceptable coagulation profile, measured within 7 days prior to the first dose of AP1, defined as: Prothrombin time (PT) or international normalized ratio (INR) ≤1.5 times ULN; and Activated partial thromboplastin time (aPTT) ≤1.5 times ULN.

12. Prior anti-cancer therapies must wash-out such that they can neither cause drug-drug interaction with AP1 nor interfere with the anti-cancer evaluation of AP1. Therefore, the wash-out has to meet all the following criteria: 1) patients must have recovered from the previous therapy to Grade 1 or baseline of significant toxicities, excluding alopecia; and 2) 5 half-lives or 4 weeks (whichever is shorter) must have expired, unless the prior anti-cancer therapy and AP1 do not interfere with each other's metabolism; and 3) 5 half-lives or 4 weeks (whichever is shorter) must have expired, unless the patient unequivocally progressed during the prior anti-cancer therapy. Palliative radiotherapy for bone lesions ≤2 weeks prior to the first dose of AP1 is acceptable if acute toxicity has resolved.

13. Negative serum or urine pregnancy test within 2 days prior to the first dose of AP1 for women of child-bearing potential, defined as a sexually mature woman who has not undergone a hysterectomy or who has not been naturally post-menopausal for ≥24 consecutive months (i.e., who has had menses any time in the preceding 24 consecutive months).

14. All patients (males and females) of child-bearing potential must agree to use an effective method of birth control (i.e., latex condom, diaphragm, cervical cap, intra-uterine device [IUD], birth control pill, etc.) beginning two weeks prior to the first dose of AP1 and for 30 days after the last dose of AP1.

15. Ability to understand and willingness to sign a written informed consent form.

Exclusion Criteria:

Patients who meet any of the following criteria at screening or Day −1 are excluded:

1. Previous treatment with investigational agents that inhibit MDM2 or MDMX activity.

2. Relapse within 75 days of autologous bone marrow transplant.

3. Prior allogeneic stem cell transplantation, unless immunosuppressants are no longer required and there is no active graft versus host disease.

4. Known central nervous system (CNS) lymphoma [computed tomography (CT) or magnetic resonance imaging (MRI) scans are required only if brain metastasis is suspected clinically.

5. Known hypersensitivity to any study drug component.

6. Current, clinically significant coagulopathy or platelet disorder, as determined by the Investigator.

7. Required concurrent use of anti-coagulants or anti-platelet medication, with the exception of aspirin doses ≤81 mg/day, low-dose subcutaneous (SC) heparin or SC low-molecular-weight heparin for DVT prophylaxis, or heparin flushes to maintain IV catheter patency.

8. Patients with pre-existing history of or known cardiovascular risk: History of acute coronary syndromes within 6 months prior to the first dose of AP1 (including myocardial infarction, unstable angina, coronary artery bypass graft, angioplasty, or stenting); Uncontrolled hypertension; Pre-existing cardiac failure (New York Heart Association Class III-IV); Atrial fibrillation on anti-coagulants; Clinically significant uncontrolled arrhythmias; Severe valvulopathy; or Corrected QT (QTc) interval on screening electrocardiogram (ECG) ≥450 msec for males and ≥470 msec for females (QTc ≥480 msec for any patient with a bundle branch block).

9. Clinically significant gastrointestinal bleeding within 6 months prior to the first dose of AP1.

10. Clinically significant third-space fluid accumulation (e.g., ascites requiring tapping despite the use of diuretics; or pleural effusion that requires tapping or is associated with shortness of breath).

11. Pregnant or lactating females.

12. Evidence of serious and/or unstable pre-existing medical, psychiatric, or other condition (including laboratory abnormalities) that could interfere with patient safety or provision of informed consent to participate in this study.

13. Active uncontrolled infection, including HIV/AIDS or Hepatitis B or C.

14. Known history of another primary malignancy that has not been in remission for ≥1 year. Non-melanoma skin cancer and cervical carcinomas in situ or squamous intra-epithelial lesions (e.g., cervical intraepithelial neoplasia [CIN] or prostatic intraepithelial/intraductal neoplasia [PIN]) are allowed.

15. Any psychological, sociological, or geographical condition that could potentially interfere with compliance with the study protocol and follow-up schedule.

16. The required use of any concomitant medications that are predominantly cleared by hepatobiliary transporters, organic anion transporter polypeptide [OATP] members OATP1B1 and OATP1B3, on the day of the AP1 infusion or within 48 hours after an AP1 infusion.

17. Hereditary angioedema of any severity or history of severe or life-threatening angioedema due to any cause.

c. Phase 2a Dose Expansion in MDM2 Amplified or MDM2/CDK4 Co-Amplified Solid Tumors with AP1 and Palbociclib Inclusion Criteria:

Patients must meet all of the following criteria to be considered for participation in this study:

1. Histologically-confirmed solid tumor malignancy that is: a) relapsed or refractory, following at least one prior line of medical therapy; and b) either MDM2 amplified or MDM2/CDK4 co-amplified, based on local or central laboratory testing by NGS, FISH or CGH. Tissue must be available for analysis at a central laboratory, even if enrolling based on alternative (e.g. local or commercial) test results. Alternative laboratory results require approval by the Medical Monitor prior to enrollment. Specimens must have been obtained after any previous exposure to palbociclib or any other CDK4/6 inhibitor.

2. At least one target lesion that is measurable by RECIST 1.1 or RANO or other appropriate response criteria.
3. Males and females aged 12 years and older
4. ECOG performance status of 0 to 1
5. Adequate hematopoiesis, defined as: a) Absolute neutrophil count (ANC) ≥1.5×10⁹/L; b) Hemoglobin ≥9.0 g/dL (without transfusions in the past 2 weeks); and c) Platelets ≥100×10⁹/L.
6. Adequate hepatic function, defined as: a) In the absence of disease involvement of the liver: bilirubin ≤1.5 times institutional upper limit of normal (ULN), and aspartate aminotransferase (AST) and alanine aminotransferase (ALT) ≤2.5 times ULN; and b) In the presence of disease involvement of the liver: bilirubin ≤2 times institutional ULN and AST and ALT ≤5 times ULN.
7. Adequate renal function, defined as serum creatinine ≤1.5 times institutional ULN, or calculated creatinine clearance ≥50 mL/min (Cockcroft Gault formula).
8. 5 half-lives or 4 weeks, whichever is shorter, must have elapsed since any prior anticancer agent was administered, unless the patient unequivocally progressed during that therapy and the agent would not be expected to interfere with AP1 or palbociclib metabolism or impede clinical assessments.
9. Recovery from the acute toxic effects of all prior therapies to ≤Grade 1 or baseline, excluding alopecia.
10. Provision of informed consent and, where applicable, pediatric assent.
11. Agreement to use acceptable methods of pregnancy prevention, if of child-bearing potential.

Exclusion Criteria:
Patients who meet any of the following criteria at screening or Day −1 are excluded:
1. Tumors with known mutations or deletions in TP53 or Rb.
2. Known hypersensitivity to any component of study medication.
3. Symptomatic or untreated CNS metastases.
4. Pulmonary embolism within the past 6 months or DVT that has not been fully treated.
5. Clinically significant cardiovascular risk factors, including: myocardial infarction, unstable angina, coronary artery bypass grafting, stenting, angioplasty, or acute coronary syndrome in the past 6 months; New York Heart Association Class III or IV heart failure; clinically significant uncontrolled arrhythmia; corrected QT (QTc) interval ≥450 msec for males and ≥470 msec for females (QTc >480 msec for any patient with a bundle branch block).
6. Uncontrolled hypertension.
7. Active, uncontrolled infection, including HIV, hepatitis B, or hepatitis C.
8. HPV-positive malignancy.
9. Ascites requiring paracentesis or pleural effusion requiring pleurocentesis or causing dyspnea.
10. Hereditary angioedema of any severity or history of clinically significant angioedema, due to any cause.
11. Major surgery within 3 weeks prior to the first dose of AP1.
12. History of another malignancy within the past year, excluding nonmelanoma skin cancers, carcinomas in situ, or other malignancies with ≥95% 5-year survival.
13. Pregnant or lactating females.
14. Required use of medications that are primarily cleared by hepatobiliary transporters, including organic anion transporters, OATP1B1 and OATP1B3, and BSEP, unless administration is not required on the day of or within 48 hours following AP1 administration.
15. Required use of medications that are strong inhibitors or moderate to strong inducers of CYP3A.
16. Administration of any investigational agent, regardless of indication, within the 2 weeks prior to enrollment, unless a minimum of 5 half-lives have elapsed.
17. Any medical, psychological, or social condition that would interfere with patient safety or the conduct of the study.

Example 30: Study Procedures

Biopsies:
A fresh or archival biopsy taken pre-dose must be sent to the central laboratory for TP53 and/or MDM2 and CDK4 amplification testing. For patients in the PTCL expansion cohorts, an additional pre-treatment tumor sample is required to be available for central pathology read (if requested).

In the Phase 2a EXP PTCL cohorts, optional biopsies are taken for PD purposes as well as for TP53 testing: during screening, during treatment, and at times of suspected progression. In the palbociclib combination cohort, if a biopsy is taken for any reason during the study, the samples are used for further analysis. Samples are submitted for whole exome sequencing (with paired germline samples) and RNA sequencing (RNAseq), and results are compared between pre-treatment and on-treatment, and times of suspected progression. Tumor samples are examined for markers of disease response and resistance. Protein expression via immunohistochemistry and RNA expression via quantitative RT-PCR are examined on specimens obtained prior to beginning treatment, during treatment with AP1, and then upon suspected progression.

Germline DNA:
Germline DNA is collected via a buccal swab only for patients in Phase 2a EXP PTCL cohorts who consent to optional biopsies.

Medical and Disease History:
The medical history of patients includes demographic information, cancer history, including disease duration, previous treatment regimens, and toxicities, as well as information about the patient's non-malignancy-related history and all prior surgeries.

Vital Signs:
Vital signs include blood pressure, pulse, respiration rate, and body temperature. Collection times are indicated in the schedule of events. Additional vital signs are collected at the discretion of the investigator.

Electrocardiograms:
Screening and pre-dose ECGs (if required) are performed in triplicate (5-10 min between readings). ECGs are to be performed after the patient has been supine for at least 10 minutes. All ECGs should be performed with the patient in the same physical position. Post-dose ECGs (if required) are performed in triplicate (5-10 min between readings) only if the patient has a QTc that is a) >500 msec; b) increased by 60 msec over pre-dose; or c) decreased by 50 msec below pre-dose recording.

Physical Examination:
A full physical examination is performed at Screening, Day 1 pre-dose, and End of Treatment; all other physical examinations (if required) are symptom-directed. Each patient's weight is collected at Screening and on Day 1 (or up to 3 days prior) of each cycle. Each patient's height is obtained only at the Screening visit.

Laboratory Assessments:

Laboratory assessments are performed locally, and include: Clinical chemistry (glucose, calcium, albumin, total protein, sodium, potassium, $CO_2$, chloride, phosphate, BUN [blood urea nitrogen], serum creatinine, uric acid, ALP, ALT, AST, LDH, total and direct bilirubin); Hematology (complete blood count, platelets and differential); Urinalysis (dipstick measurement [pH, specific gravity, protein, glucose, ketones, nitrite, leukocyte esterase] with microscopic analysis, if results of the dipstick indicate additional testing required); Coagulation (PT, INR, aPTT); Serum or urine pregnancy test (β-hCG) for women of child-bearing potential; At select visits, lymphocyte subset testing is performed (B-cells, T-cells including CD4 and CD8, natural killer (NK) cells); C-reactive protein, fibrinogen, and reticulocytes are collected at select visits; HPV testing of tumor tissue from cancers likely to be HPV-positive is performed depending on the cancer type, including (but not limited to) cervical cancer, oropharyngeal cancer, head and neck squamous cell cancers or anal cancer; or HIV, Hepatitis B and C testing.

Disease Assessments and Imaging:

RECIST 1.1- or iRECIST- (for solid tumor patients), RANO- (for glioblastoma patients), or IWG 2014- (for lymphoma patients) compliant imaging scans, photographs, physical examination, and/or laboratory-based assays (e.g., prostate specific antigen) for patients with relevant disease indications are obtained at baseline (within 21 days of Cycle 1 Day 1) and for objective anti-tumor activity as outlined below. The same type of imaging, physical examination, or laboratory-based assay procedure is used for each assessment of a patient. In EXP, all study images are made available to be sent for central imaging read, if requested.

After dosing commences, tumor assessments are performed as follows: for DR-A, DR-A-2, combination (AP1 plus palbociclib), images are obtained prior to the start of Cycle 3 and every other cycle thereafter, e.g., prior to Cycles 5, 7, and 9; for DR-B, DR-C, images are obtained prior to the start of Cycle 4 and every third cycle thereafter, e.g., prior to Cycles 7, 10, and 11; for DEP, after 1 year of treatment, assessments are obtained at approximately 3 month intervals. After 2 years of treatment, assessments are obtained at approximately 4 month intervals or per standard of care. In EXP, the frequency of imaging does not change after 1 year of treatment; and End of Treatment assessments are required only if the patient did not have a tumor assessment within the prior 6-8 weeks.

Concomitant Medications:

Concomitant medications (current medications and those taken within 28 days of Cycle 1, Day 1) are taken through the end of treatment visit or until start of subsequent anticancer therapy.

PK and PD Assessments:

Blood samples for PK and PD assessments are collected at the time points shown in the tables below. Patients who are already enrolled in the expansion and consent to this testing have blood drawn at their next available cycle (i.e. if the next available cycle is Cycle 4, the patients follow the PK/PD Cycle 1 testing at Cycle 4 [with the exception of germline DNA and cfDNA testing which remains on the below schedule], and follow the below indicated Cycle 2 testing at Cycle 5). TABLE 18 shows the schedule for PK and PD assessments for DR-A and DR-A-2 patients receiving AP1 as single agent therapy. TABLE 19 shows the schedule for PK and PD assessments for DR-B patients receiving AP1 as single agent therapy. TABLE 20 shows the schedule for PK and PD assessments for DR-C patients receiving AP1 as single agent therapy. TABLE 21 shows the schedule for PK and PD assessments for patients receiving AP and palbociclib.

TABLE 18

| | | PK | PD |
|---|---|---|---|
| Screening | | | |
| During screening | | | cfDNA |
| Cycle 1 | | | |
| Day 1 | within one hour before start of infusion (SOI) | X | MIC-1<br>CTC (select sites only)<br>Germline DNA (EXP only) |
| | End of Infusion (EOI) (+5 min) | X | |
| | 30 min after EOI (±5 min) | X | |
| | 1 hr after EOI (±5 min) | X | |
| | 2 hr after EOI (±10 min) | X | |
| | 4 hr after EOI (±10 min) | X | MIC-1<br>CTC (select sites only) |
| | 8 hr after EOI (±2 hours) | X | MIC-1<br>CTC (select sites only) |
| Day 2 | 24 hours (±4 hr) after SOI day prior | X | MIC-1<br>CTC (select sites only) |
| Day 3 (DEP only) | 48 hours (±4 hr) after SOI | X | MIC-1 |
| Cycle 2 | | | |
| Day 15 | EOI (+5 min) | X | |
| | 1 hr after EOI (±5 min) | X | |
| | 4 hr after EOI (±10 min) | X | |
| Day 16 (DEP only) | 24 hours (±4 hr) after SOI day prior | X | |
| Cycle 5 | | | |
| Day 1 | within one hour before SOI | | cfDNA |
| End of Treatment | | | |
| | End of Treatment | | cfDNA |

TABLE 19

| | | PK | PD |
|---|---|---|---|
| Screening | | | |
| During screening | | | cfDNA |
| Cycle 1 | | | |
| Day 1 | within one hour before SOI | X | MIC-1<br>CTC (select sites only)<br>Germline DNA (EXP only) |
| | EOI (+5 min) | X | |
| | 30 min after EOI (±5 min) | X | |
| | 1 hr after EOI (±5 min) | X | |
| | 2 hr after EOI (±10 min) | X | |
| | 4 hr after EOI (±10 min) | X | MIC-1<br>CTC (select sites only) |
| | 8 hr after EOI (±2 hours) | X | MIC-1<br>CTC (select sites only) |
| Day 2 | 24 hours (±4 hr) after SOI day prior | X | MIC-1<br>CTC (select sites only) |
| Day 3 (DEP only) | 48 hours (±4 hr) after SOI | X | MIC-1 |
| Day 4 | within one hour before SOI | X | MIC-1 |

TABLE 19-continued

|  |  | PK | PD |
|---|---|---|---|
| Cycle 2 | | | |
| Day 11 | EOI (+5 min) | X | |
|  | 1 hr after EOI (±5 min) | X | |
|  | 4 hr after EOI (±10 min) | X | |
| Day 12 (DEP only) | 24 hours (±4 hr) after SOI day prior | X | |
| Cycle 5 | | | |
| Day 1 | within one hour before SOI | | cfDNA |
|  | End of Treatment | | |
|  | End of Treatment | | cfDNA |

TABLE 20

|  |  | PK | PD |
|---|---|---|---|
| Screening | | | |
|  | During screening | | cfDNA |
| Cycle 1 | | | |
| Day 1 | within one hour before SOI | X | MIC-1 |
|  |  | | Germline DNA |
|  |  | | CTC (select sites only) |
|  | EOI (+5 min) | X | |
|  | 30 min after EOI (±5 min) | X | |
|  | 1 hr after EOI (±5 min) | X | |
|  | 2 hr after EOI (±10 min) | X | |
|  | 4 hr after EOI (±10 min) | X | MIC-1 |
|  |  | | CTC (select sites only) |
|  | 8 hr after EOI (±2 hours) | X | MIC-1 |
|  |  | | CTC (select sites only) |
| Day 2 (optional) | 24 hours (±4 hr) after SOI day prior | | MIC-1 |
|  |  | | CTC (select sites only) |
| Day 3 | within one hour before SOI | X | MIC-1 |
|  | EOI (+5 min) | X | |
| Day 5 | within one hour before SOI | X | MIC-1 |
|  | EOI (+5 min) | X | |
|  | 1 hr after EOI (±5 min) | X | |
|  | 2 hr after EOI (±10 min) | X | |
| Day 8 | Any time | X | MIC-1 |
| Cycle 2 | | | |
| Day 5 | within one hour before SOI | X | |
|  | EOI (+5 min) | X | |
|  | 1 hr after EOI (±5 min) | X | |
|  | 2 hr after EOI (±10 min) | X | |

TABLE 20-continued

|  |  | PK | PD |
|---|---|---|---|
| Cycle 5 | | | |
| Day 1 | within one hour before SOI | | cfDNA |
|  | End of Treatment | | |
|  | End of Treatment | | cfDNA |

TABLE 21

|  |  | PK Sampling | |
|---|---|---|---|
| | Cycle 1 | AP1 | Palbociclib |
| Day 1 | within one hour before start of AP1 infusion (SOI) | X | |
|  | End of Infusion (EOI) (+5 min) | X | |
|  | 30 min after EOI (±5 min) | X | |
|  | 1 hr after EOI (±5 min) | X | |
|  | 2 hr after EOI (±10 min) | X | |
|  | 4 hr after EOI (±10 min) | X | |
| Day 2 | 24 hrs (±2 hr) after EOI Day 1/ 18 hrs (±2 hr) after Day 1 palbociclib dose | X | X |
| Day 8 | within one hour before AP1 SOI | X | X |
|  | EOI (+5 min) | X | X |
| Day 9 | 24 hrs (±2 hr) after EOI Day 8/ 18 hrs (±2 hr) after Day 8 palbociclib dose | X | X |
| Day 15 | within one hour before AP1 SOI | X | X |
|  | EOI (+5 min) | X | X |
| Day 16 | 24 hrs (±2 hr) after EOI Day 15/ 18 hrs (±2 hr) after Day 15 palbociclib dose | X | X |

End of Treatment and End of Study:

Approximately 30 days (+/−5 days) after the last dose of the study drug, an end of treatment visit is conducted. For patients in Phase 1, this visit is the same as the end of study. Patients in Phase 2 remain on the study and are followed for survival and subsequent therapies.

TABLE 22 shows the study activities for DR-A and DR-A-2 in patients receiving AP1 as single agent therapy. TABLE 23 shows the study activities for cycle 2 and beyond of DR-A and DR-A-2 in patients receiving AP1 as single therapy. TABLE 24 shows the study activities for DR-B through cycle 1. TABLE 25 shows the study activities for cycle 2 and beyond for DR-B. TABLE 26 shows the study activities through cycle 1 for DR-C. TABLE 27 shows the study activities for cycle 2 and beyond for DR-C. TABLE 28 shows the study activities through cycle 1 for patients receiving a combination of AP1 and palbociclib. TABLE 29 shows the study activities for cycle 2 and beyond for patients receiving a combination of AP1 and palbociclib.

TABLE 22

| | Molecular Screen | Clinical Screen-21 days | Within 7 days prior to Day 1 | Day 1 Pre-Dose | Day 1 Post-Dose | Day 2 | Day 3 DEP only | Day 8 EXP: ±1 d Pre-Dose | Day 8 EXP: ±1 d Post-Dose | Day 15 EXP: ±1 d Pre-Dose | Day 15 EXP: ±1 d Post-Dose | Day 16 | Day 22[15] ±1 d |
|---|---|---|---|---|---|---|---|---|---|---|---|---|---|
| Written informed consent | See 6.2 | See 6.2 | | | | | | | | | | | |
| Medical and disease history | | X | | | | | | | | | | | |
| Demographics | | X | | | | | | | | | | | |
| Tumor biopsy or archive tissue sample | See 3.2[1] | | | | | | | | | | | | |
| Eligibility | | X | X | | | | | | | | | | |
| Blood test for HIV, hepatitis B and C | | X | | | | | | | | | | | |
| HPV test[3] | | X | | | | | | | | | | | |
| Serum or urine pregnancy test | | | Within 2 days prior to Day 1 | | | | | | | | | | |

TABLE 22-continued

| | Molecular Screen | Clinical Screening 21 days | Within 7 days prior to Day 1 | Day 1 Pre-Dose | Day 1 Post-Dose | Day 2 | Day 3 DEP only | Day 8 EXP: ±1 d Pre-Dose | Day 8 EXP: ±1 d Post-Dose | Day 15 EXP: ±1 d Pre-Dose | Day 15 EXP: ±1 d Post-Dose | Day 16 | Day 22[15] ±1 d |
|---|---|---|---|---|---|---|---|---|---|---|---|---|---|
| Vital signs[4] | | X | X | X | X | X | X | X | X | X | X | X | X |
| Physical exam[5] | | X | | X | | | | X | | X | | | |
| 12-lead ECG[6] | | X | | X | X | | | | | | | | |
| Laboratory assessments-chemistry | | X | X[2] | X | | X | X | X | | X | | X | |
| Laboratory assessments-hematology | | X | X[2] | X | | X | X | X | | X | | X | X |
| Laboratory assessments-coagulation | | X | X[2] | X | | X | X | X | | X | | X | |
| Laboratory assessments-urinalysis | | X | X[2] | X | | X | X | X | | X | | X | |
| Laboratory assessments-lymphocyte subset testing | | | X | | | | X | | X | | | | |
| Laboratory assessments-CRP, fibrinogen | | | X | X | | X | X | X | | X | | X | |
| Laboratory assessments-reticulocytes | | | | X | | | | | | | | | |
| Blood Collection-immunogenicity | | | | X[7] | | | | | | | | | |
| Blood Collection-PD assessments-MIC-1 | | | | X[7] | X[7] | X[8] | X[9] | | | | | | |
| Blood Collection-PD assessments-CTC DEP and select sites in EXP | | | | X[7] | X[7] | X[8] | | | | | | | |
| Blood Collection-PK assessments | | | | X[7] | X[7] | X[8] | X[9] | | | | | | |
| Blood Collection-cell-free DNA | X | | | | | | | | | | | | |
| Germline DNA sample[10] | | | | X | | | | | | | | | |
| ECOG Performance Status | | X | X | | | | | X | | X | | | |
| Biopsy for biomarker assessments/p53 status | | | | | | | | | | | | | X[1] |
| Tumor Assessment/Imaging[11] | | X | | | | | | | | | | | |
| AP1 dosing[12] | | | | | | | | | | | | | |
| Concomitant medications[13] | | X | X | | | | | | | | | | |
| AE assessment[14] | | | | | | | | | | | | | |

DEP: For Days 1 through 16, no pre-specified visit windows exist to ensure timely safety follow-up and PK/PD sampling. However, at the Investigator's discretion, it may be necessary to conduct a study visit on an alternative day than described in this schedule in order to protect the safety, rights, or welfare of the patient. If this is the situation, the Investigator confers with and obtains approval from the Medical Monitor.

[1]A pre-treatment biopsy or archival sample is required for p53 testing. For patients with a study biopsy performed immediately prior to enrollment, an optional needle biopsy is performed within 24 hours of Cycle 1 Day 15 infusion OR Cycle 2 Day 15 infusion. A decision is made at the discretion of the Investigator. In EXP, optional biopsies include pre-treatment, during treatment, and one or more at times of suspected and/or confirmed progression.

[2]Can be omitted if screening laboratory assessments are performed within 7 days of the first dose of AP1. Screening/within 7 day assessments are used for eligibility assessment.

[3]HPV status is determined for tumors that are associated with HPV infection, including (but not limited to) cervical cancers, oropharyngeal cancer, head and neck squamous cell cancers or anal cancer, unless HPV status of the tumor is already known and documented.

[4]Blood pressure, pulse, respiration rate, body temperature.

Cycle 1, Days 1, 8, 15: On the days of drug administration, vital signs are recorded pre-dose (within 30 minutes prior to SOI) and at the following time points:

During infusion:

DR-A (one hour infusion): 15 min (±3 min) and 30 min (±3 min)

DR-A-2 (two hour infusion): 30 min (±3 min) and 60 min (±3 min)

Post-infusion: At EOI (±5 min), 1 hr (±5 min) and 2 hr (±10 min), 4 hrs (±10 min) following EOI. On Cycle 1 Day 1 additional time points include 6 hrs (±10 min) and 8 hrs (±10 min) following EOI. Additional vital signs are collected at the discretion of the investigator.

[5]Full physical examination is performed at Screening, Day 1 Predose, and End of Treatment; all other physical examinations are symptom directed. Height and weight information are collected on Day 1.

[6]ECGs are performed after the patient has been supine for at least 10 minutes. Readings are performed with the patient in the same physical position. Screening and pre-dose ECG recordings are taken in triplicate with 5-10 minutes between readings. Thereafter, subsequent readings on that same day are performed in triplicate only if a patient has a QTc that is a) >500 msec; b) increased by 60 msec over pre-dose; or c) decreased by 50 msec below pre-dose value. Timepoints on Cycle 1, Day 1: Pre-dose (within 30 minutes prior to infusion), end of infusion (EOI +5 min) and at 1 (±5 min) and 2 hr (±10 min) after EOI.

[7]PD (MIC-1 and CTC): Within 1 hour before the start of infusion (SOI), and 4 (±10 min) and 8 hours (±2 hours) after EOI.

PK: Within 1 hour before SOI; at EOI (+5min) and at 30 min (±5 min), 1 hour (±5 min), 2 (±10 min), 4 (±10 min) and 8 hours (±2 hours) after EOI.

Immunogenicity: Within 1 hour before the SOI on Day 1.

Patients who are already enrolled in the expansion and consent to this PD/PK testing have blood drawn at their next available cycle (i.e. if the next available cycle is Cycle 4, PK/PD Cycle 1 testing is followed at Cycle 4, and follows the indicated Cycle 2 testing at Cycle 5).

[8]PD (CTC and MIC-1) and PK: blood is collected 24 hours (±4 h) after the initiation of Day 1 infusion.

[9]DEP only: PD (MIC-1 only) and PK: blood is collected 48 hours (±4 h) after the initiation of Day 1 infusion.

[10]In patients consenting to optional biopsies, buccal swab for germline DNA (EXP only)

[11]RECIST 1.1-(for solid tumor patients) or IWG 2014-(for lymphoma patients) compliant imaging for disease assessment and tumor measurements as well as laboratory-based assays (e.g., prostate specific antigen) for patients with relevant disease indications.

[12]During the first two cycles, AP1 is administered in the morning to allow observation of delayed infusion reactions. In dosing regimen DR-A, AP1 is infused over 1 hour (±15 min). In dosing regimen DR-A-2, AP1 is infused over 2 hours (±15 min), with dexamethasone (4 mg orally or IV) administered 4 hours after the end of infusion to mitigate potential infusion reactions. At the end of the infusion for both DR-A and DR-A-2, IV fluids (saline) or oral fluids (500 mL-1000 mL) are administered unless clinically contraindicated.

[13]All concomitant medications taken within 28 days of beginning the study (Cycle 1 Day 1) until 30 days after last infusion or start of subsequent therapy re reported in the relevant eCRF pages, including supportive care drugs and drugs used for treatment of AEs or chronic diseases.

[14]AE reporting begins at the point of the first AP1 infusion until 30 days after last infusion or start of subsequent therapy; until all drug-related toxicities and ongoing SAEs have resolved, whichever is later; or until the Investigator assesses AEs as "chronic" or "stable."

[15]This visit is performed for all patients in DEP and performed in EXP only if the patient has experienced any grade 3 neutropenia, anemia or thrombocytopenia while on study, regardless of the relationship to AP1

TABLE 23

| | Day 1[1] ±3 d | | Day 8 ±1 d | | Day 15 ±1 d | | Day 16[8] ±2 d | At the end of cycles 2, 4, 6, etc. | End-of-Treatment 30 ± 5 after last dose or at study withdrawal | Long-Term Follow Up (EXP only)[16] |
|---|---|---|---|---|---|---|---|---|---|---|
| | Pre-dose | Post-dose | Pre-dose | Post-dose | Pre-dose | Post-dose | | | | |
| Serum or urine pregnancy | | | | | | | | | X | |
| Vital signs[2] | X | X | X | X | X | X | X | | X | |
| Physical exam[3] | X | | X | | X | | | | X | |
| 12-lead ECG[4] | X | X | | | | | | | X | |
| Laboratory assessments-chemistry[5] | X | | | | X | | | X | X | |
| Laboratory assessments-hematology[5] | X | | X | | X | | | X | X | |
| Laboratory assessments-coagulation[5] | X | | | | X | | | X | X | |
| Laboratory assessments-urinalysis[5] | X | | | | X | | | X | X | |
| Laboratory assessments-CRP, fibrinogen | Cycle 2 only | | | | Cycle 2 only | | | Cycle 2 only | | |
| Collection of blood for immunogenicity[6] | Cycle 2, 3, 5 only | | | | | | | | X | |
| Blood Collection-PK assessments | | | | | Cycle 2 only[7] | Cycle 2 only[7] | Cycle 2: DEP only[7] | | | |
| Blood Collection-cell-free DNA[6] | Cycle 5 only | | | | | | | | X | |
| ECOG Performance status[9] | X | | X | | X | | | | X | |
| Biopsy for biomarker assessments/p53 status[10] | | | | | | | X | | X | |
| Tumor Assessment/Imaging[11] | | | | | | | | X | X[12] | |
| AP1 dosing[13] | X | | X | | X | | | | | |
| Concomitant medications[14] | X | X | X | X | X | X | X | | X | |
| AE assessment[15] | X | X | X | X | X | X | X | | X | |
| Phone calls or other contact | | | | | | | | | | X |

[1]"Day 29" = Day 1 of next cycle for patients continuing reatment Day 1 pre-dose evaluations for Cycle 2 and subsequent cycles are done within 3 days prior to next cycle drug administration.

[2]Blood pressure, pulse, respiration rate, body temperature. For patients on >1 year, this procedure is not a mandatory study procedure:

On the days of drug administration (Days 1, 8, 15 of each cycle) vital signs are recorded pre-dose (within 30 minutes prior to SOI) and at the following time points:

During infusion:

DR-A (one hour infusion): 15 min (±3 min) and 30 min (±3 min)

DR-A-2 (two hour infusion): 30 min (±3 min) and 60 min (±3 min).

Post-infusion: At EOI (±5 min) and as clinically indicated following EOI. In cycle 2 only, vital signs are collected at 1 hr (±5 min), 2 hrs (±10 min) and 4 hrs (±10 min) following EOI. Additional vital signs are collected at the discretion of the investigator.

[3]Full physical examination is performed at End of Treatment visit; all other physical examinations are symptom directed. For patients on >1 year, this procedure is not a mandatory study procedure. Weight information is collected on Day 1 (+/−3 days) of each cycle.

[4]ECGs are performed after the patient has been supine for at least 10 minutes. Readings are performed with the patient in the same physical position. Pre-dose ECG recordings are taken in triplicate with 5-10 minutes between readings. Thereafter, subsequent readings on that same day are performed in triplicate only if patient has a QTc that is a) >500 msec; b) increased by 60 msec over pre-dose; or c) decreased by 50 msec below pre-dose value. Timepoints on Day 1 of new cycle: At pre-dose (within 30 minutes prior to infusion) and EOI (+5min). For patients on >1 year, this procedure is not a mandatory study procedure.

[5]For patients on >1 year, the required labs are: full labs to be collected on Day 1, and hematology only at Day 15

[6]Within 1 hour before SOI

[7]PK (Cycle 2 only): Day 15-collect at EOI (+5 min) and at 1 hour (±5 min) and 4 hours (±10 min) after the end of infusion. Patients who are already enrolled in the expansion and consent to this PD/PK testing have blood drawn at their next available cycle (i.e. if the next available cycle is Cycle 4, follow the PK/PD Cycle 1 testing at Cycle 4, and the indicated Cycle 2 testing at Cycle 5). PK (Cycle 2 only): DEP only-Day 16-Blood is collected 24 hours (±4 h) after the initiation of Day 15 infusion.

[8]Day 16 visit is only be completed for Cycle 2; this visit is completed in DEP and only in EXP if the optional biopsy is performed

[9]For patients on > 1 year, this is not a mandatory study procedure

[10]Cycle 2 biopsy is not performed if collected in specified timepoint in Cycle 1. For patients with a study biopsy performed immediately prior to enrollment, an optional needle biopsy is performed within 24 hours of Cycle 1 Day 15 infusion OR Cycle 2 Day 15 infusion; decision to be made at the discretion of the Investigator. In EXP, optional biopsies include pre-treatment, during treatment, and one or more at times of suspected and/or confirmed progression.

[11]Performed at end of even-numbered cycles (Cycle 2, Cycle 4, Cycle 6, etc.) prior to start of the next treatment cycle. RECIST 1.1 measurements for patients with solid tumors; IWG 2014 measurements for patients with lymphoma. In DEP, after 1 year, assessments are obtained at approximately 3 month intervals. After 2 years, assessments are obtained at approximately 4 month intervals or per standard of care. In EXP, the frequency of imaging does not change after 1 year of treatment.

[12]Same method used as baseline. Perform only if no tumor assessment was performed within 6-8 weeks prior.

[13]During the first two cycles, AP1 is administered in the morning to allow observation of delayed infusion reactions. In dosing regimen DR-A, AP1 is infused over 1 hour (±15 min). In dosing regimen DR-A-2, AP1 is infused over 2 hours (±15 min), with dexamethasone (4 mg orally or IV) administered 4 hours after the end of infusion to mitigate potential infusion reactions. At the end of the infusion for both DR-A and DR-A-2, IV fluids (saline) or oral fluids (500 mL-1000 mL) are administered unless clinically contraindicated.

[14]All concomitant medications taken within 28 days of beginning the study (Cycle 1 Day 1) until 30 days after last infusion or start of subsequent therapy are reported in the relevant eCRF pages, including supportive care drugs and drugs used for treatment of AEs or chronic diseases.

[15]AE reporting begins at the point of the first AP1 infusion and continues until 30 days after last infusion or start of subsequent therapy; until all drug-related toxicities and ongoing SAEs have resolved, whichever is later; or until the Investigator assesses AEs as "chronic" or "stable."

[16]EXP only: Phone calls or other contact are made approximately every 2 months following end of treatment visit to assess survival status and collect information on subsequent therapies

TABLE 24

| | Molecular Screen | Clinical Screen-21 days | Within 7 days prior to Day 1 | Day 1 Pre-Dose | Day 1 Post-Dose | Day 2 | Day 3[9] | Days 4 and 8 EXP: ±1 d Pre-Dose | Days 4 and 8 EXP: ±1 d Post-Dose | Day 11 EXP: ±1 d Pre-Dose | Day 11 EXP: ±1 d Post-Dose | Day 12 DEP only | Day 15 ±1 d EXP only | Day 18 ±1 d DEP only |
|---|---|---|---|---|---|---|---|---|---|---|---|---|---|---|
| Written informed consent | See 6.2 | See 6.2 | | | | | | | | | | | | |
| Medical and disease history | | X | | | | | | | | | | | | |
| Demographics | | X | | | | | | | | | | | | |
| Tumor biopsy or archive tissue sample | | See 3.2[1] | | | | | | | | | | | | |
| Eligibility | | X | X | | | | | | | | | | | |
| Blood test for HIV, hepatitis B and C | | X | | | | | | | | | | | | |
| HPV test [3] | | X | | | | | | | | | | | | |
| Serum or urine pregnancy test | | | Within 2 days prior to Day 1 | | | | | | | | | | | |
| Vital signs[4] | | X | X | X | X | X | X | X | X | X | X | X | X | X |
| Physical exam[5] | | X | | X | | | | X | | X | | | | |
| 12-lead ECG[6] | | X | | X | X | | | | | | | | | |
| Laboratory assessments-chemistry | | X | X[2] | X | | X | X | X | | X | | X | X | |
| Laboratory assessments-hematology | | X | X[2] | X | | X | X | X | | X | | X | X | X |
| Laboratory assessments-coagulation | | X | X[2] | X | | X | X | X | | X | | X | X | |
| Laboratory assessments-urinalysis | | X | X[2] | X | | X | X | X | | X | | X | X | |
| Laboratory assessments-lymphocyte subset testing | | | X | | | X | | X | | | | | | |
| Laboratory assessments-CRP, fibrinogen | | | X | X | | X | X | X | | X | | X | X | |
| Laboratory assessments-reticulocytes | | | | X | | | | | | | | | | |
| Blood Collection-immunogenicity | | | | X[7] | | | | | | | | | | |
| Blood Collection-PD assessments-M1C-1 | | | | X[7] | X[7] | X[8] | X[9] | X[9] | | | | | | |
| Blood Collection-PD assessments-CTC | | | | X[7] | X[7] | X[8] | | | | | | | | |
| DEP and select sites in EXP Blood Collection-PK assessments | | | | X[7] | X[7] | X[8] | X[9] | X[9] | | | | | | |
| Blood Collection-cell-free DNA | X | | | | | | | | | | | | | |
| Germline DNA sample[10] | | | | X | | | | | | | | | | |
| ECOG Performance Status | | X | X | | | | | X | | X | | | | |
| Biopsy for biomarker assessments/p53 status | | | | | | | EXP: Day 3 or 10[1] | | | | | | DEP: X[1] | |
| Tumor Assessment/Imaging[11] | | X | | | | | | | | | | | | |
| AP1 dosing[12] | | | | | | | | | | | | | | |
| Concomitant medications[13] | | X | X | | | | | | | | | X | X | X |
| AE assessment[14] | | | | | | | | | | | | X | X | X |

DEP: For Days 1 through 12 no pre-specified visit windows exist to ensure timely safety follow-up and PK/PD sampling. However, at the Investigator's discretion, a study visit is conducted on an alternative day than described in the schedule in order to protect the safety, rights, or welfare of the patient. If this is the situation, the Investigator confers with and obtains approval from the Medical Monitor.

[1] A pre-treatment biopsy or archival sample is required for p53 testing. For patients with a study biopsy performed immediately prior to enrollment, an optional needle biopsy is performed within 24 (DEP) or 48 (EXP) hours of Cycle 1 Day 11 infusion OR Cycle 2 Day 11 infusion. In EXP, optional biopsies include pre-treatment, during treatment, and one or more at times of suspected and/or confirmed progression.

[2] Can be omitted if screening laboratory assessments are performed within 7 days of the first dose of AP1. Screening/within 7 day assessments are used for eligibility assessment.

[3] HPV status is determined for tumors that are associated with HPV infection, including (but not limited to) cervical cancers, oropharyngeal cancer, head and neck squamous cell cancers or anal cancer, unless HPV status of the tumor is already known and documented.

[4] Blood pressure, pulse, respiration rate, body temperature.
Cycle 1, Days 1, 4, 8, 11: On the days of drug administration vital signs are recorded pre-dose (within 30 minutes prior to SOI) and at the following time points:
During infusion: 15 min (±3 min) and 30 min (±3 min)
Post-infusion: At EOI (±5 min), 1 (±5 min), 2 hrs (±10 min) and 4 hrs (±10 min) following EOI. On Cycle 1 Day 1 additional time points include 6 hrs (±10 min) and 8 hrs (±10 min) following EOI. Additional vital signs are collected at the discretion of the investigator.

[5] Full physical examination is performed at Screening, Day 1 Predose and End of Treatment; all other physical examinations are symptom directed. Weight information is collected on Day 1.

6ECGs are performed after the patient has been supine for at least 10 minutes. Readings are performed with the patient in the same physical position. Screening and pre-dose ECG recording are taken in triplicate with 5-10 minutes between readings. Thereafter, subsequent readings on that same day are performed in triplicate only if patient has a QTc that is a) >500 msec; b) increased by 60 msec over pre-dose; or c) decreased by 50 msec below pre-dose value. Timepoints on Cycle 1, Day 1: Pre-dose (within 30 minutes prior to infusion), end of infusion (EOI +5 min) and at 1 (±5 min) and 2 hours (±10 min) after EOI.

[7] PD (MIC-1 and CTC): within 1 hour before the start of infusion (SOI) and 4 (±10 min) and 8 hr (±2 hours) after EOI.
PK: Within 1 hour before SOI; at EOI (±5 min) and at 30 min (±5 min), 1 hour (±5 min), 2 (±10 min), 4 (±10 min) and 8 hours (±2 hours) after EOI.
Immunogenicity: Within 1 hour before the SOI on Day 1.

[8] PD (CTC and MIC-1) and PK: Day 2: Collect blood samples 24 hours (±4 h) after the initiation of Day 1 infusion.

[9] PD (MIC-1 only) and PK: Day 3 (Day 3 for DEP only): Collect blood samples 48 hours (± 4 h) after the initiation of Day 1 infusion. Day 4:
Collect blood samples within 1 hour prior to SOI. Visit to be completed in EXP only if biopsy performed. In EXP, PK and PD not collected at this visit.

[10] In patients consenting to optional biopsies, buccal swab for germline DNA (EXP only)

[11] RECIST 1.1-(for solid tumor patients) or IWG 2014-(for lymphoma patients) compliant imaging for disease assessment and tumor measurements as well as laboratory-based assays (e.g., prostate specific antigen) for patients with relevant disease indications.

[12] During the first two cycles, AP1 is administered in the morning to allow observation of delayed infusion reactions. AP1 is infused over 1 hour (±15 min). At the end of the infusion, IV fluids (saline) or oral fluids (500 mL-1000 mL) are administered unless clinically contraindicated.

[13] All concomitant medications taken within 28 days of beginning the study (Cycle 1 Day 1) until 30 days after last infusion or start of subsequent therapy are reported in the relevant eCRF pages, including supportive care drugs and drugs used for treatment of AEs or chronic diseases.

TABLE 24-continued

| | Molecular Screen | Clinical Screening 21 days | Within 7 days prior to Day 1 | Day 1 Pre-Dose | Day 1 Post-Dose | Day 2 | Day 3[9] | Days 4 and 8 EXP: ±1 d Pre-Dose | Days 4 and 8 EXP: ±1 d Post-Dose | Day 11 EXP: ±1 d Pre-Dose | Day 11 EXP: ±1 d Post-Dose | Day 12 DEP only | Day 15 ±1 d EXP only | Day 18 ±1 d DEP only |
|---|---|---|---|---|---|---|---|---|---|---|---|---|---|---|

[14] AE reporting begins at the point of the first AP1 infusion and continues until 30 days after last infusion or start of subsequent therapy; until all drug-related toxicities and ongoing SAEs have resolved, whichever is later; or until the Investigator assesses AEs as "chronic" or "stable."

TABLE 25

| | Day 1[1] ± 3 d Pre-dose | Day 1[1] ± 3 d Post-dose | Day 3 EXP only[9] | Day 4 and 8 ± 1 d Pre-dose | Day 4 and 8 ± 1 d Post-dose | Day 11 ± 1 d Pre-dose | Day 11 ± 1 d Post-dose | Day 12[15] DEP only | Day 15[16] EXP only | After last dose in cycles 3, 6, 9 etc. | End-of-Treatment 30 ± 5 d after last dose or at study withdrawal | Long-Term Follow Up [17] (EXP only) |
|---|---|---|---|---|---|---|---|---|---|---|---|---|
| Serum or urine pregnancy | | | | | | | | | | | X | |
| Vital signs[2] | X | X | | X | X | X | X | X | X | | X | |
| Physical exam[3] | X | | | X | | X | | | | | X | |
| 12-lead ECG[4] | X | X | | | | | | | | | X | |
| Laboratory assessments-chemistry[5] | X | | | | | Starting at Cycle 4 | | X | X | | X | |
| Laboratory assessments-hematology[5] | X | | | X | | Starting at Cycle 4 | | X | X | | X | |
| Laboratory assessments-coagulation[5] | X | | | | | | | | X | | X | |
| Laboratory assessments-urinalysis[5] | X | | | | | | | X | | | X | |
| Laboratory assessments-CRP, fibrinogen | Cycle 2 only | | | | | Cycle 2 only | | | Cycle 2 only | | | |
| Collection of blood for immunogenicity[6] | Cycle 2, 3, 5 only | | | | | | | | | | X | |
| Blood Collection-PK assessments | | | | | | X.[7] | | X[7] | X[7] | | | |
| Blood Collection-cell-free DNA[6] | Cycle 5 only | | | | | | | | | | X | |
| ECOG Performance status[8] | X | | | X | | X | | | | | X | |
| Biopsy for biomarker assessments/p53 status | | | Day 3 or 10[9] | | | | | X[9] | | | X[9] | |
| Tumor Assessment/Imaging | | | | | | | | | | X[10] | X[11] | |
| AP1 dosing[12] | X | | | X | | X | | | | | | |
| Concomitant medications[13] | X | X | | X | X | X | X | X | X | | X | |
| AE assessment[14] | X | X | | X | X | X | X | X | X | | X | |
| Phone calls or other contact | | | | | | | | | | | | X |

[1] "Day 22" = Day 1 of next cycle for patients continuing treatment. Day 1 pre-dose evaluations for Cycle 2 and subsequent cycles are done within 3 days prior to next cycle drug administration.
[2] Blood pressure, pulse, respiration rate, body temperature. On the days of drug administration (Days 1, 4, 8, and 11 of each cycle) vital signs are recorded pre-dose (within 30 minutes prior to SOI) and at the following time points:
(During infusion) 15 min (±3 min) and 30 min (±3 min);
(Post-infusion) At EOI (±5 min) and as clinically indicated following EOI. For patients on >1 year, this procedure is not a mandatory study procedure.
In cycle 2 only, vital signs are collected at 1 hr (±5 min), 2 hrs (±10 min) and 4 hrs (±10 min) following EOI. Additional vital signs are collected at the discretion of the investigator.
[3] Full physical examination is performed at End of Treatment; all other physical examinations are symptom directed. For patients on >1 year, this procedure is not a mandatory study procedure. Weight information is collected on Day 1 (+/− 3 days) of each cycle.
[4] ECGs are performed after the patient has been supine for at least 10 minutes. Readings are performed with the patient in the same physical position. Screening and pre-dose ECG recording are taken in triplicate with 5-10 minutes between readings. Thereafter, subsequent readings on that same day are performed in triplicate only if patient has a QTc that is a) >500 msec; b) increased by 60 msec over pre-dose; or c) decreased by 50 msec below pre-dose value. Timepoints on Day 22 of prior cycle or Day 1 of new cycle: At pre-dose (within 30 minutes prior to infusion) and EOI (+5 min). For patients on >1 year, this procedure is not a mandatory study procedure.
[5] For patients on >1 year, the required labs are: full labs are collected on Day 1, and hematology information is collected only on Day 11
[6] Within 1 hour before SOI
[7] PK (Cycle 2 only): Day 11 collect at EOI (+5 min) and at 1 hour (±5 min) and 4 hours (±10 min) after the end of infusion.
DEP only: PK (Cycle 2 only): Day 12 visit is conducted and blood is collected 24 hours (±4 h) after the initiation of Day 11 infusion.
[8] For patients on >1 year, this procedure is not a mandatory study procedure.
[9] Cycle 2 biopsy is not performed if collected in specified time point in Cycle 1. For patients with a study biopsy performed immediately prior to enrollment, an optional needle biopsy is performed within 24 hours (DEP) or 48 hours (EXP) of Cycle 1 Day 11 infusion OR Cycle 2 Day 11 infusion. In EXP, optional biopsies include pre-treatment, during treatment, and one or more at times of suspected and/or confirmed progression.
[10] To be performed at end of odd-numbered cycles (Cycle 3, 6, 9, etc.) prior to start of the next treatment cycle. RECIST 1.1 measurements for patients with solid tumors; IWG 2014 measurements for patients with lymphoma. In DEP, after 1 year, assessments are obtained at approximately 3 month intervals. After 2 years, assessments are obtained at approximately 4 month intervals or per standard of care. In EXP, the frequency of imaging does not change after 1 year of treatment.
[11] Same method used as baseline. Perform only if no tumor assessment was performed within 6-8 weeks prior.
[12] During the first two cycles, AP1 is administered in the morning to allow observation of delayed infusion reactions. AP1 is infused over 1 hour (±15 min). At the end of the infusion, IV fluids (saline) or oral fluids (500 mL-1000 mL) are administered unless clinically contraindicated.
[13] All concomitant medications taken within 28 days of beginning the study (Cycle 1 Day 1) until 30 days after last infusion or start of subsequent therapy are reported in the relevant eCRF pages, including supportive care drugs and drugs used for treatment of AEs or chronic diseases.
[14] AE reporting begins at the point of the first AP1 infusion until 30 days after last infusion or start of subsequent therapy; until all drug-related toxicities and ongoing SAEs have resolved, whichever is later; or until the Investigator assesses AEs as "chronic" or "stable."
[15] Day 12 visit is only be completed for Cycle 2
[16] Day 15 visit is completed in Cycles 1-3 and then at the discretion of the investigator
[17] EXP only: Phone calls or other contact are made approximately every 2 months following end of treatment visit to assess survival status and collect information on subsequent therapies.

TABLE 26

| | Molecular Screen | Clinical Screen-21 days | Within 7 days prior to Day 1 | Day 1 Pre-Dose | Day 1 Post-Dose | Day 2[15] | Days 3 ±1 d Pre-Dose | Days 3 ±1 d Post-Dose | Day 5 ±1 d Pre-Dose | Day 5 ±1 d Post-Dose | Day 8 ±1 d | Day 15 ±1 d |
|---|---|---|---|---|---|---|---|---|---|---|---|---|
| Written informed consent | | See 6.2 | See 6.2 | | | | | | | | | |
| Medical and disease history | | | X | | | | | | | | | |
| Demographics | | | X | | | | | | | | | |
| Tumor biopsy or archive tissue sample | | See 3.2[1] | | | | | | | | | | |
| Eligibility | | | X | X | | | | | | | | |
| Blood test for HIV, hepatitis B and C | | | X | | | | | | | | | |
| HPV test[3] | X | | | | | | | | | | | |
| Serum or urine pregnancy test | | | Within 2 days prior to Day 1 | | | | | | | | | |
| Vital signs[4] | | X | X | X | X | X | X | X | X | X | X | X |
| Physical exam[5] | | X | X | | X | | | X | | X | X | X |
| 12-lead ECG[6] | | X | | X | X | | | | | | | |
| Laboratory assessments-chemistry | | X | X[2] | X | | X | X[7] | | X[7] | | X[7] | X[7] |
| Laboratory assessments-hematology | | X | X[2] | X | | X | X[7] | | X[7] | | X[7] | X[7] |
| Laboratory assessments-coagulation | | X | X[2] | X | | X | | | | | | |
| Laboratory assessments-urinalysis | | X | X[2] | X | | X | | | | | | |
| Laboratory assessments-lymphocyte subset testing | | | X | | | | | | X | | | |
| Laboratory assessments-CRP, fibrinogen | | | X | X | | X | X | | X | | X | X |
| Laboratory assessments-reticulocytes | | | | X | | | | | | | | |
| Blood Collection-immunogenicity | | | | X[8] | | | | | | | | |
| Blood Collection-PD assessments-MIC-1 | | | | X[8] | X[8] | X[9] | X[10] | | X[10] | | X[10] | |
| Blood Collection-PD assessments-CTC (select sites only) | | | | X[8] | X[8] | X[9] | | | | | | |
| Blood Collection-PK assessments | | | | X[8] | X[8] | | X[10] | X[10] | X[10] | X[10] | X[10] | |
| Blood Collection-cell-free DNA | X | | | | | | | | | | | |
| Germline DNA sample[11] | | | | X | | | | | | | | |
| ECOG Performance Status | | X | X | | | | X | | X | | | |
| Biopsy for biomarker assessments/ p53 status | | | | | | Day 2 or 4[1] | | | | | | |
| Tumor Assessment/Imaging[12] | | | X | | | | | | | | | |
| AP1 dosing[13] | | | | | | | | | | | | |
| Concomitant medications[14] | | X | X | | | | | | | | | X |
| AE assessment[15] | | | | | | | | | | | | X |

[1]For patients with a study biopsy performed immediately prior to enrollment a needle biopsy is performed within 24 hours after Day 1 infusion OR Day 3 infusion; decision is made at the discretion of the Investigator and only for patients with a study biopsy prior to their study participation. A pre-treatment biopsy or archival sample is required for p53 testing. For patients with a study biopsy performed immediately prior to enrollment, an optional needle biopsy is performed within 24 hours of Cycle 1 Day 1 infusion OR Day 3 infusion. A biopsy is optionally performed at visit 2. Decision is made at the discretion of the Investigator. In EXP, optional biopsies include pre-treatment, during treatment, and one or more at times of suspected and/or confirmed progression.

[2]Can be omitted if screening laboratory assessments are performed within 7 days of the first dose of AP1. Screening/within 7 day assessments are used for eligibility assessment.

[3]HPV status is determined for tumors that are associated with HPV infection, including (but not limited to) cervical cancers, oropharyngeal cancer, head and neck squamous cell cancers or anal cancer, unless HPV status of the tumor is already known and documented.

[4]Blood pressure, pulse, respiration rate, body temperature.

Cycle 1, Days 1, 3, 5: On the days of drug administration, vital signs are recorded pre-dose (within 30 minutes prior to SOI) and at the following time points:

During infusion: 15 min (±3 min) and 30 min (±3 min)

Post-infusion: At EOI (±5 min), 1 (±5 min), 2 (±10 min) and 4 hrs (±10 min) following EOI. On Cycle 1 Day 1 additional time points include 6 hrs (±10 min) and 8 hrs (±10 min) following EOI. Additional vital signs are collected at the discretion of the investigator.

[5]Full physical examination is performed at Screening, Day 1 Pre-dose and End of Treatment; all other physical examinations are symptom directed. Weight information is collected at Day 1.

[6]ECGs are performed after the patient has been supine for at least 10 minutes. Readings are performed with the patient in the same physical position. Screening and pre-dose ECG recordings are taken in triplicate with 5-10 minutes between readings. Thereafter, subsequent readings on that same day are performed in triplicate only if patient has a QTc that is a) >500 msec; b) increased by 60 msec over pre-dose; or c) decreased by 50 msec below pre-dose value. Timepoints on Cycle 1, Day 1: Pre-dose (within 30 minutes prior to infusion), end of infusion (EOI +5 min) and at 1 (±5 min) and 2 hours (±10 min) after EOI.

[7]Days 3 and 5: Perform hematology and the following chemistries: glucose, sodium, potassium, CO2, chloride, BUN [blood urea nitrogen], serum creatinine Day 8 and 15: Perform hematology and clinical chemistry.

[8]PD (MIC-1 and CTC): within 1 hour before the start of infusion (SOI) and at 4 (±10 min) and 8 hours (±2 hours) after EOI.

PK: Within 1 hour before SOI; at EOI (±5 min) and at 30 min (±5 min), 1 hour (±5 min), 2 (±10 min), 4 (±10 min) and 8 hours (±2 hours) after EOI.

Immunogenicity: Within 1 hour before the SOI on Day 1.

[9]PD (MIC-1 and CTC): Day 2: Collect blood samples 24 hours (±4 h) after the initiation of Day 1 infusion. Complete visit only if CTCs are being collected, or if optional biopsy being conducted.

[10]PD (MIC-1 only): Day 3 and 5: Collect blood samples within 1 hour prior to SOI.

PK Day 3: Collect blood samples within one hour prior to SOI and at EOI (±5 min)

PK Day 5: Within 1 hour before SOI; at EOI (+5 min), at 1 hour (±5 min), 2 (±10 min) hours post EOI PD (MIC-1 only) and PK: Day 8: Collect blood samples at any time

[11]In patients consenting to optional biopsies, buccal swab for germline DNA (EXP only)

[12]RECIST 1.1-(for solid tumor patients) or IWG 2014-(for lymphoma patients) compliant imaging for disease assessment and tumor measurements as well as laboratory-based assays (e.g., prostate specific antigen) for patients with relevant disease indications.

[13]During the first two cycles, AP1 is administered in the morning to allow observation of delayed infusion reactions. AP1 is infused over 1 hour (±15 min). At the end of the infusion, IV fluids (saline) or oral fluids (500 mL-1000 mL) is administered unless clinically contraindicated. Patients receive AP1 within 1 day of the scheduled dose, but must not receive AP1 on consecutive dosing days.

[14]All concomitant medications taken within 28 days of beginning the study (Cycle 1 Day 1) until 30 days after last infusion or start of subsequent therapy are reported in the relevant eCRF pages, including supportive care drugs and drugs used for treatment of AEs or chronic diseases.

[15]AE reporting begins at the point of the first AP1 infusion until 30 days after last infusion or start of subsequent therapy; until all drug-related toxicities and ongoing SAEs have resolved, whichever is later; or until the Investigator assesses AEs as "chronic" or "stable.

TABLE 27

| | Day 1[1] ±3 d | | | Day 3 ±1 d | | Day 5 ±1 d | | | | After last dose in cycles | End-of-Treatment 30 ± 5 d after last dose or at | Long-Term |
|---|---|---|---|---|---|---|---|---|---|---|---|---|
| | Pre-dose | Post-dose | Day 2[9] | Pre-dose | Post-dose | Pre-dose | Post-dose | Day 8 ± 1 d | Day 15[15] ±1 d | 3, 6, 9 etc. | study withdrawal | Follow Up [16] |
| Serum or urine pregnancy | | | | | | | | | | | X | |
| Vital signs2 | X | X | | X | X | X | X | X | X | | X | |
| Physical exam[3] | X | | | X | | X | | | X | | X | |
| 12-lead ECG4 | X | X | | | | | | | | | X | |
| Laboratory assessments-chemistry[5] | X | | | | | | | X | X | | X | |
| Laboratory assessments-hematology[5] | X | | | | | | | X | X | | X | |
| Laboratory assessments-coagulation[5] | X | | | | | | | | | | X | |
| Laboratory assessments-urinalysis[5] | X | | | | | | | | | | X | |
| Laboratory assessments-CRP, fibrinogen | Cycle 2 only | | | | | | | Cycle 2 only | Cycle 2 only | | X | |
| Collection of blood for immunogenicity[6] | Cycle 2, 3, 5 only | | | | | | | | | X | | |
| Blood Collection-PK assessments | | | | | | Cycle 2 only7 | Cycle 2 only[7] | | | | | |
| Blood Collection-cell-free DNA[6] | Cycle 5 only | | | | | | | | | | X | |
| ECOG Performance status[8] | X | | | X | | X | | | | | X | |
| Biopsy for biomarker assessments/p53 status | | | Day 2 or 4[9] | | | | | | | | X[9] | |
| Tumor Assessment/Imaging | | | | | | | | | | X[10] | X[11] | |
| AP1 dosing[12] | X | | | X | | X | | | | | | |
| Concomitant medications[13] | X | X | | X | X | X | X | X | X | | X | |
| AE assessment[14] | X | X | | X | X | X | X | X | X | | X | |
| Phone calls or other contact | | | | | | | | | | | | X |

[1]"Day 22" = Day 1 of next cycle for patients continuing treatment. Day 1 pre-dose evaluations for Cycle 2 and subsequent cycles are done within 3 days prior to next cycle drug administration.
[2]Blood pressure, pulse, respiration rate, body temperature. On the days of drug administration (Days 1, 3 and 5 of each cycle) vital signs are recorded pre-dose (within 30 minutes prior to SOI) and at the following time points:
(During infusion) 15 min (±3 min) and 30 min (±3 min);
(Post-infusion) At EOI (±5 min) and as clinically indicated following EOI. For patients on >1 year, this procedure is not a mandatory study procedure.
In cycle 2 only, vital signs are collected at 1 hr (±5 min), 2 hrs (±10 min) and 4 hrs (±10 min) following EOI. Additional vital signs are collected at the discretion of the investigator.
[3]Full physical examination is performed at End of Treatment; all other physical examinations are symptom directed. For patients on >1 year, this procedure is not a mandatory study procedure. Weight information is collected on Day 1 (+/−3 days) of each cycle.
[4]ECGs are performed after the patient has been supine for at least 10 minutes. Readings are performed with the patient in the same physical position. Screening and pre-dose ECG recording are taken in triplicate with 5-10 minutes between readings. Thereafter, subsequent readings on that same day are performed in triplicate only if patient has a QTc that is a) >500 msec; b) increased by 60 msec over pre-dose; or c) decreased by 50 msec below pre-dose value. Timepoints on Day 1 of new cycle: At pre-dose (within 30 minutes prior to infusion) and EOI (+5 min). For patients on >1 year, this procedure is not a mandatory study procedure.
[5]For patients on >1 year, the required labs are: full labs to be collected on Day 1, and hematology only at Day 8.
[6]Within 1 hour before SOI
[7]PK (Cycle 2 only): Collect within 1 hour before SOI, at EOI (±5 min), 1 hour (±5 min), and 2 hours (±10 min) after the end of infusion.
[8]For patients on >1 year, this procedure is not a mandatory study procedure.
[9]Cycle 2 biopsy is not performed if collected in Cycle 1. For patients with a study biopsy performed immediately prior to enrollment, an optional needle biopsy is performed within 24 hours of Cycle 2 Day 1 infusion OR Day 3 infusion; decision to be made at the discretion of the Investigator. Visit to be performed only if biopsy performed. In EXP, optional biopsies include pre-treatment, during treatment, and one or more at times of suspected and/or confirmed progression.
[10]To be performed at end of odd-numbered cycles (Cycle 3, 6, 9, etc.) prior to start of next treatment cycle. RECIST 1.1 measurements for patients with solid tumors; IWG 2014 measurements for patients with lymphoma. In EXP, the frequency of imaging does not change after 1 year of treatment.
[11]Perform only if no tumor assessment was performed within 6-8 weeks prior.
[12]During the first two cycles, AP1 is administered in the morning to allow observation of delayed infusion reactions. AP1 is infused over 1 hour (±15 min). At the end of the infusion, IV fluids (saline) or oral fluids (500 mL-1000 mL) are administered unless clinically contraindicated. Patients receive AP1 within 1 day of the scheduled dose, but do not receive AP1 on consecutive dosing days.
[13]All concomitant medications taken within 28 days of beginning the study (Cycle 1 Day 1) until 30 days after last infusion or start of subsequent therapy are reported in the relevant eCRF pages, including supportive care drugs and drugs used for treatment of AEs or chronic diseases.
[14]AE reporting begins at the point of the first AP1 infusion until 30 days after last infusion or start of subsequent therapy; until all drug-related toxicities and ongoing SAEs have resolved, whichever is later; or until the Investigator assesses AEs as "chronic" or "stable."
[15]Day 15 visit is completed in Cycles 1-3 and then at the discretion of the investigator.
[16] Phone calls or other contact are made approximately every 2 months following end of treatment visit to assess survival status and collect information on subsequent therapies.

TABLE 28

| Procedure | Screening-21 days | Day 1 | | | Day 8 ±1 d | | | Day 15 ±1 d | | | Day 22 ±1 d |
|---|---|---|---|---|---|---|---|---|---|---|---|
| | | Pre-Dose | Post-Dose | Day 2 | Pre-Dose | Post-Dose | Day 9 | Pre-Dose | Post-Dose | Day 16 | |
| Written informed consent/pediatric assent | X | | | | | | | | | | |
| Medical and disease history | X | | | | | | | | | | |
| Demographics | X | | | | | | | | | | |
| Tumor biopsy or archive tissue sample (NGS testing) | X | | | | | | | | | | |
| Eligibility | X | | | | | | | | | | |

TABLE 28-continued

| | | Day 1 | | | Day 8 ±1 d | | | Day 15 ±1 d | | | |
|---|---|---|---|---|---|---|---|---|---|---|---|
| Procedure | Screening-21 days | Pre-Dose | Post-Dose | Day 2 | Pre-Dose | Post-Dose | Day 9 | Pre-Dose | Post-Dose | Day 16 | Day 22 ±1 d |
| HPV test (tumor)[1] | X | | | | | | | | | | |
| Serum or urine pregnancy test | X | | | | | | | | | | |
| Vital signs[2] | Within 7 days prior to Day 1 | X | X | X | X | X | | X | X | | X |
| Physical exam[3] | X | X | | | | | | | | | |
| 12-lead ECG[4] | X | | | | | | | | | | |
| Laboratory assessments-chemistry | Within 7 days prior to Day 1 | X | | X | X | | | X | | | X |
| Laboratory assessments-hematology | Within 7 days prior to Day 1 | X | | X | X | | | X | | | X |
| Laboratory assessments-coagulation | Within 7 days prior to Day 1 | X | | X | X | | | X | | | X |
| Laboratory assessments-reticulocytes | | X | | | | | | | | | |
| Blood Collection-immunogenicity | | Within 1 hour before SOI | | | | | | | | | |
| Blood Collection-PK assessments | | X[5] | X[5] | X[5] | X[5] | X[5] | X[5] | X[5] | | | |
| ECOG Performance Status | Within 7 days prior to Day 1 | X | | | X | | X | | | | |
| Tumor Assessment/Imaging | Within 28 days prior to Day 1 | | | | | | | | | | |
| AP1 dosing[6] | X | | | | X | | | X | | | |
| Palbociclib dosing[6] | Administered orally on Days 1 to 21 of each 28-day cycle with food | | | | | | | | | | |
| Patient diary[7] | Record daily during palbociclib dosing | | | | | | | | | | |
| Concomitant medications | Within 28 days prior to C1D1 until 30 days after last infusion or start of subsequent therapy | | | | | | | | | | |
| AE assessment | AE collection period begins with first dose of AP1 until 30 days post last dose or start of subsequent therapy | | | | | | | | | | |

[1] HPV status is determined only for tumors that are associated with HPV infection, including (but not limited to) cervical cancers, oropharyngeal cancer, head and neck squamous cell cancers or anal cancer, unless HPV status of the tumor is already known and documented.
[2] Blood pressure, pulse, respiration rate, body temperature.
Cycle 1, Days 1, 8, 15: On the days of drug administration vital signs are recorded pre-dose (within 30 minutes prior to SOI) and at the following time points:
During infusion: 15 min (±3 min) and 30 min (±3 min)
Post-infusion: At EOI (±5 min), 1 hr (±5 min) and 2 hr (±10 min), 4 hrs (±10 min) following EOI. On Cycle 1 Day 1 additional time points include 6 hrs (±10 min) and 8 hrs (±10 min) following EOI.
Additional vital signs are collected at the discretion of the investigator.
[3] Full physical examination is performed at Screening (including height), Day 1 Predose, and End of Treatment; all other physical examinations are symptom directed. Weight information is collected on Day 1.
[4] ECGs are performed after the patient has been supine for at least 10 minutes. Readings are performed with the patient in the same physical position. ECG recording are taken in triplicate with 5-10 minutes between readings.
[5] PK time points are as follows:
Cycle 1 Day 1: AP1 samples: within 1 hour before SOI; at EOI (+5 min) and at 30 min (±5 min), 1-hour (±5 min), 2 (±10 min), and 4 (±10 min) hours after EOI.
Cycle 1 Day 2: AP1 sample: 24 hours (±2 hours) post EOI; palbociclib: 18 hours (±2 hours) post dose
Cycle 1 Day 8 and 15: AP1 samples: within 1 hour before SOI; at EOI (+5 min), Palbociclib samples: within 1 hour before SOI; at EOI (±5 min) of AP1 dosing.
Cycle 1 Day 9 and 16: AP1 sample: 24 hours (±2 hours) post EOI; palbociclib: 18 hours (±2 hours) post dose
[6] During the first two cycles, AP1 is administered in the morning to allow observation of delayed infusion reactions. AP1 is infused over 1 hour (±15min). At the end of the infusion, IV fluids (saline) or oral fluids (500 mL-1000 mL) re administered unless clinically contraindicated. On days when both drugs are administered (Days 1, 8, and 15), palbociclib is administered at least 6 hours following the infusion of API. It is recommended that palbociclib be administered with food at approximately the same time each day.
[7] Patients to record time of palbociclib administration in diary. In addition, the number of capsules dispensed and returned is recorded for each patient.

TABLE 29

| | Day 1[1] ±3 d | | Day 8 ±1 d | | Day 15 ± 1 d | | End-of-Treatment 30 ± 5 d after last dose or at study withdrawal | Long-Term Follow Up[11] |
|---|---|---|---|---|---|---|---|---|
| Procedure | Pre-dose | Post-dose | Pre-dose | Post-dose | Pre-dose | Post-dose | | |
| Serum or urine pregnancy | | | | | | | X | |
| Vital signs[2] | X | X | X | X | X | X | X | |
| Physical exam[3] | X | | | | | | X | |
| Biopsy (NGS testing)[4] | X | | | | | | | |
| Laboratory assessments-chemistry[5] | X | | | | X | | X | |
| Laboratory assessments-hematology[5] | X | | X | | X | | X | |
| Laboratory assessments-coagulation[5] | X | | | | X | | X | |
| Collection of blood for immunogenicity[6] | Cycle 2, 3, 5 only | | | | | | X | |
| ECOG Performance status[7] | X | | X | | X | | X | |
| P53 status | If a biopsy is collected at any time on study, p53 testing should be performed | | | | | | | |
| Tumor Assessment/Imaging | Performed at end of even-numbered cycles (Cycle 2, 4, 6, etc.) prior to start of the next treatment cycle. After 1 year on treatment is assessed after every third cycle, at the discretion of the investigator | | | | | | X[8] | |

TABLE 29-continued

| Procedure | Day 1[1] ±3 d | | Day 8 ±1 d | | Day 15 ±1 d | | End-of-Treatment 30 ± 5 d after last dose or at study withdrawal | Long-Term Follow Up[11] |
|---|---|---|---|---|---|---|---|---|
| | Pre-dose | Post-dose | Pre-dose | Post-dose | Pre-dose | Post-dose | | |
| AP1 dosing[9] | X | | X | | X | | | |
| Palbociclib dosing[9] | Administered orally on Days 1 to 21 of each 28-day cycle with food | | | | | | | |
| Patient diary[10] | Record daily during palbociclib dosing | | | | | | | |
| Concomitant medications | Within 28 days prior to C1D1 until 30 days after last infusion or start of subsequent therapy | | | | | | X | |
| AE assessment | | | | | | | X | |
| Phone calls or other contact | | | | | | | | X |

[1]"Day 29" = Day 1 of next cycle for patients continuing treatment. Day 1 pre-dose evaluations for Cycle 2 and subsequent cycles are done within 3 days prior to next cycle drug administration.
[2]Blood pressure, pulse, respiration rate, body temperature. For patients on >1 year, this procedure is not a mandatory study procedure.
On the days of drug administration (Days 1, 8, 15 of each cycle), vital signs are recorded pre-dose (within 30 minutes prior to SOI) and at the following time points:
During infusion: 15 min (±3 min) and 30 min (±3 min)
Post-infusion: At EOI (±5 min) and as clinically indicated following EOI.
Additional vital signs are collected at the discretion of the investigator.
[3]Weight information is collected at Day 1 (or up to 3 days prior) of each cycle.
[4]Biopsies are not required per protocol however if a biopsy is taken during the study a sample should be submitted to the central laboratory for next generation sequencing
[5]For patients on >1 year, the required labs are: full labs are collected on Day 1, and hematology only at Day 15
[6]Within 1 hour before SOI
[7]For patients on >1 year, this is not a mandatory study procedure
[8]Same method used as baseline. Perform only if no tumor assessment was performed within 6-8 weeks prior.
[9]During the first two cycles, AP1 is administered in the morning to allow observation of delayed infusion reactions. AP1 is infused over 1 hour (±15 min). At the end of the infusion, IV fluids (saline) or oral fluids (500 mL-1000 mL) are administered unless clinically contraindicated. On days when both drugs are administered (Days 1, 8, and 15), palbociclib is administered at least 6 hours following the infusion of AP 1. It is recommended that palbociclib be administered with food at approximately the same time each day.
[10]Patients to record time of palbociclib administration in diary. In addition, the number of capsules dispensed and returned are recorded for each patient.
[11]Phone calls or other contact is made approximately every 2 months following end of treatment visit to assess survival status and collect information on subsequent therapies.

Example 31: Statistical Methods

For each phase of study, results are summarized by dose level and regimen. Tabulations are produced for appropriate demographic and baseline clinical characteristics, efficacy, pharmacokinetic, and safety parameters. For categorical variables, summary tabulations of the number and percentage of patients within each category of the parameter are presented. For continuous variables, the number of patients, mean, median, standard deviation, minimum, and maximum values are presented. Time-to-event data is summarized using Kaplan-Meier methodology using 25th, 50th (median), and 75th percentiles with associated 2-sided 95% confidence intervals. Graphical displays are presented, as appropriate. Results are evaluated for all patients.

Patient Disposition and Characteristics:

The baseline characteristics of patients enrolled are summarized. All patients who received study treatment are accounted for, including patients who died or withdrew from study treatment during the study.

Safety Analysis:

The safety population includes all patients who received at least one dose of AP1. Adverse events, vital sign measurements, clinical laboratory information and concomitant medication usage are tabulated. All toxicities are summarized by severity based on the NCI CTCAE version 4.03 and relationship to treatment. Serious adverse events are listed separately. Graphical displays are provided where useful in the interpretation of results. Statistical analyses are descriptive in nature and account for all dose levels and regimens studied.

Pharmacokinetic Analysis:

Levels of AP1 and its metabolite (and other agents given in combination with AP1) are measured in blood samples collected at specific time points. Pharmacokinetic data are tabulated and summarized by individual patient and collectively by dose level for each dose regimen. Graphical displays are provided where useful in the interpretation of results.

Pharmacodynamic Analysis:

Levels of p53, MDM2, MDMX, p21 and caspase are measured in tumor specimens collected before beginning treatment, during Cycle 1 or Cycle 2 and at suspected disease progression. MIC-1 and CTCs are measured in blood samples. Pharmacodynamic effects on the composition of cell free DNA from blood are evaluated. Pharmacodynamic data are tabulated and summarized by individual patient and collectively by dose level. Graphical displays are provided where useful in the interpretation of results.

Clinical Activity Analysis:

To evaluate clinical activity, response rates and duration of response based on RECIST 1.1, IWG 2014, RANO, iRECIST, or other appropriate or exploratory criteria are analyzed.

In DEP, the efficacy evaluable population consists of patients who: Received at least one dose of AP1 at a dose level at least 0.8 mg/kg per infusion; Have at least one post-baseline evaluation or had clinical progression and Are TP53 wild type or indeterminate. In the single agent EXP cohorts, the efficacy evaluable population consists of patients who: Received at least one dose of AP1; Have at least one post-baseline evaluation or had clinical progression and Are TP53 wild type. In the EXP cohort of patients with MDM2 amplified or MDM2/CDK4 co-amplified solid tumors, the efficacy evaluable population consists of patients who: Received at least one dose each of AP1 and palbociclib; Have at least one post-baseline evaluation or had clinical progression; and are confirmed to have MDM2 amplification (with or without CDK4 co-amplification) with TP53 and Rb wild type. A descriptive analysis of other evidence of anti-tumor activity or other clinical benefit are provided based on clinical, radiographic or other appropriate assessment of efficacy or clinical anti-tumor activity. Overall response rate, duration of response, and time to response are assessed in DEP as well as in EXP. Additional clinical activity analyses in the Phase 2a dose expansion include OS and PFS and OS at 1 year. Time-to-event endpoints are calculated from the time of first administration of AP1 (Day 1) until the stated event or end of study.

Example 32: Methods for Assessing Clinical Activity a. RECIST 1.1: Assessment of Clinical Activity for Patients with Solid Tumors Patients with measurable disease are assessed at baseline and during the study by standard criteria. Patients are reevaluated after receiving 2 cycles of study therapy and then after every 2 cycles thereafter. In the event objective response (PR or CR) is noted, changes in tumor measurements are confirmed by repeat assessments that should be performed at least 4 weeks after the criteria for response are first met. For stable disease (SD), follow-up measurements must meet the SD criteria at least 5 weeks after study entry.

Response and progression are evaluated in this study using the international criteria (version 1.1) proposed by the Response Evaluation Criteria in Solid Tumors (RECIST) Committee. Changes in only the largest diameter (unidimensional measurement) of the tumor lesions are used in RECIST 1.1. Lesions are either measurable or non-measurable using the criteria provided below.

Measurable Disease:

Measurable disease is defined by the presence of at least one measurable lesion. Measurable lesions are defined as those that can be accurately measured in at least one dimension [longest diameter (LD) in the plane of measurement to be recorded] with a minimum size of: 10 mm by CT scan (CT scan slice thickness no greater than 5 mm); 10 mm caliper measurement by clinical exam (lesions which cannot be accurately measured with calipers are recorded as non-measurable); 20 mm by chest x-ray. Malignant lymph nodes: To be considered pathologically enlarged and measurable, a lymph node must be ≥15 mm in short axis when assessed by CT scan (CT scan slice thickness no greater than 5 mm).

Non-Measurable Disease:

All other lesions (or sites of disease), including small lesions (longest diameter <10 mm or pathological lymph nodes with ≥10 to <15 mm short axis) are considered non-measurable disease. Lesions considered truly non-measurable include: leptomeningeal disease, ascites, pleural/pericardial effusions, lymphangitis cutis/pulmonis, inflammatory breast disease, abdominal masses/abdominal organomegaly identified by physical exam and not followed by CT or MRI.

Bone lesions, cystic lesions and lesions previously treated with local therapy are considered as follows: 1) Bone lesions: Bone scan, PET scan or plain films are not considered adequate imaging techniques to measure bone lesions. However, these techniques are used to confirm the presence or disappearance of bone lesions; Lytic bone lesions or mixed lytic-blastic lesions, with identifiable soft tissue components, that are evaluated by cross sectional imaging techniques (i.e., CT or MRI) are considered as measurable lesions if the soft tissue component meets the definition of measurability described above; Blastic bone lesions are non-measurable. 2) Cystic lesions: Lesions that meet the criteria for radiographically defined simple cysts are not considered malignant lesions (neither measurable nor non-measurable) since they are, by definition, simple cysts; 'Cystic lesions' thought to represent cystic metastases are considered measurable lesions, if they meet the definition of measurability described above. However, if non-cystic lesions are present in the same patient, these are preferred for selection as target lesions. 3) Lesions with prior local treatment: Tumor lesions situated in a previously irradiated area, or in an area subjected to other loco-regional therapy, are usually not considered measurable unless there has been demonstrated progression in the lesion.

Target Lesions:

All measurable lesions up to a maximum of two lesions per organ and five lesions in total, representative of all involved organs, should be identified as target lesions and recorded and measured at baseline. Target lesions should be selected on the basis of their size (lesions with the longest diameter) and their suitability for accurate repeated measurements (either by imaging techniques or clinically). A sum of the diameters (longest for non-nodal lesions, short axis for nodal lesions) for all target lesions are calculated and reported as the baseline sum diameters. The baseline sum diameters re used as reference by which to characterize the objective tumor response.

Lymph Node Assessment:

For lymph nodes, measurements are made of the short axis, which is defined as perpendicular to the LD of node assessed in the plane of measurement: Target lesion if short axis ≥15 mm; Non-target lesion if short axis is ≥10 but <15 mm; Normal if short axis <10 mm. For baseline, add the actual short axis measurement to the sum of LD of non-nodal lesions.

Non-Target Lesions:

All other lesions (or sites of disease) including pathological lymph nodes are identified as non-target lesions and should also be recorded at baseline. Measurements of these lesions are not required and these lesions should be followed as "present," "absent," or in rare cases "unequivocal progression." In addition, it is possible to record multiple non-target lesions involving the same organ as a single item on the case report form (e.g., 'multiple enlarged pelvic lymph nodes' or 'multiple liver metastases').

Guidelines for Evaluation of Measurable Disease:

All measurements are taken and recorded in metric notation using a ruler or calipers. All baseline evaluations are performed as closely as possible to the beginning of treatment and never more than 4 weeks before the beginning of the treatment. The same method of assessment and the same technique are used to characterize each identified and reported lesion at baseline and during follow-up. Imaging-based evaluation is preferred to evaluation by clinical examination when both methods have been used to assess the antitumor effect of a treatment.

Clinical Lesions:

Clinical lesions are only considered measurable when they are superficial and ≥10 mm diameter as assessed using calipers (e.g., skin nodules). In the case of skin lesions, documentation by color photography, including a ruler to estimate the size of the lesion, is recommended. When lesions can be evaluated by both clinical exam and imaging, an imaging evaluation is undertaken since it is more objective and is reviewed at the end of the study.

Chest x-Ray:

Chest CT is preferred over chest x-ray, particularly when progression is an important endpoint. Lesions on chest x-ray are considered measurable if they are clearly defined and surrounded by aerated lung.

Conventional CT and MRI:

This guideline has defined measurability of lesions on CT scan based on the assumption that CT slice thickness is 5 mm or less. When CT scans have slice thickness >5 mm, the minimum size for a measurable lesion is twice the slice thickness. MRI is acceptable in certain situations (e.g., for body scans).

Ultrasound (US):

US is not used to measure tumor lesions. US examinations cannot be reproduced in their entirety for independent review at a later date because they are operator dependent. If new lesions are identified by US, confirmation by CT or MRI is advised. If there is concern about radiation exposure at CT, MRI is used instead of CT.

Endoscopy, Laparoscopy:

The utilization of these techniques for objective tumor evaluation is not advised. However, such techniques can be useful to confirm complete pathological response when biopsies are obtained or to determine relapse in trials where recurrence following complete response or surgical resection is an endpoint.

Tumor Markers:

Tumor markers alone cannot be used to assess objective tumor response. If markers are initially above the upper normal limit, they are normalized for a patient to be considered in complete clinical response.

Cytology, Histology:

Cytology and histology techniques are used to differentiate between partial responses (PR) and complete responses (CR) in rare cases (e.g., residual lesions in tumor types such as germ cell tumors, where known residual benign tumors can remain).

Evaluation of Target Lesions:

Complete response (CR), partial response (PR), progressive disease (PD), and stable disease (SD) criteria are used to evaluate target lesions.

Assessment of Target Lymph Nodes:

Lymph nodes identified as target lesions always have the actual short axis measurement recorded (measured in the same anatomical plane as the baseline exam), even if the nodes regress to below 10 mm on study. In order to qualify for CR, each node achieves a short axis <10 mm. For PR, SD and PD, the actual short axis measurement of the nodes is included in the sum of target lesions.

Target Lesions that Become Too Small to Measure:

All lesions (nodal and non-nodal) recorded at baseline have their actual measurements recorded at each subsequent evaluation, even when very small (e.g., 2 mm). If it is the opinion of the radiologist that the lesion has disappeared, the measurement is recorded as 0 mm. If the lesion is believed to be present and is faintly seen but too small to measure, a default value of 5 mm is assigned.

Lesions that Split or Coalesce on Treatment:

When non-nodal lesions fragment, the longest diameters of the fragmented portions are added together to calculate the target lesion sum. Similarly, as lesions coalesce, a plane between them is maintained that would aid in obtaining diameter measurements of each individual lesion. If the lesions have truly coalesced such that they are no longer separable, the vector of the longest diameter is the maximal longest diameter for the 'coalesced lesion.'

Evaluation of Non-Target Lesions:

Complete response (CR), non-CR/non-PD, and progressive disease (PD) are used to evaluate target lesions.

New Lesions:

The finding of a new lesion is unequivocal (i.e., not attributed to differences in scanning technique, change in imaging modality, or findings thought to represent something other than tumor, such as a 'new' healing bone lesion). A lesion identified on a follow-up study in an anatomical location that was not scanned at baseline is considered a new lesion and indicates disease progression. If a new lesion is equivocal, continued therapy and follow-up evaluation clarifies if the new lesion represents truly new disease. If repeat scans confirm a new lesion, then progression is declared using the date of the initial scan.

Evaluation of Best Overall Response:

The best overall response is the best response recorded from the start of the treatment until disease progression/recurrence (taking as reference for progressive disease the smallest measurements recorded since the treatment started). The patient's best overall response assignment depends on findings of both target and non-target disease and also takes into consideration the appearance of new lesions. Furthermore, depending on the nature of the study, confirmatory measurement is required. Specifically, in non-randomized trials where response is the primary endpoint, confirmation of PR or CR is needed to deem either one the "best overall response." It is assumed that at each protocol-specified time point, a response assessment occurs. The following table provides a summary of the overall response status calculation at each time point for patients who have measurable disease at baseline.

TABLE 30 shows time point responses for patients with target and non-target disease.

TABLE 30

| Target Lesions | Non-target Lesions | New Lesions | Overall Response |
|---|---|---|---|
| CR | CR | No | CR |
| CR | Non-CR/non-PD | No | PR |
| CR | Not evaluated | No | PR |
| PR | Non-PD or not all evaluated | No | PR |
| SD | Non-PD or not all evaluated | No | SD |
| Not all evaluated | Non-PD | No | NE |
| PD | Any | Yes or No | PD |
| Any | PD | Yes or No | PD |
| Any | Any | Yes | PD |

CR = complete response,
PR = partial response,
SD = stable disease
PD = progressive disease,
NE = inevaluable Complete or partial responses are claimed only if the criteria for each are confirmed by a repeat assessment at least 4 weeks later. In this circumstance, the best overall response is interpreted as shown in TABLE 31:

TABLE 31

| Overall response First time point | Overall response Subsequent time point | BEST overall response |
|---|---|---|
| CR | CR | CR |
| CR | PR | SD, PD or PR* |
| CR | SD | SD provided minimum criteria for SD duration met, otherwise PD |
| CR | PD | SD provided minimum criteria for SD duration met, otherwise PD |
| CR | NE | SD provided minimum criteria for SD duration met, otherwise NE |
| PR | CR | PR |
| PR | PR | PR |
| PR | SD | SD |
| PR | PD | SD provided minimum criteria for SD duration met, otherwise PD |

TABLE 31-continued

| Overall response First time point | Overall response Subsequent time point | BEST overall response |
|---|---|---|
| PR | NE | SD provided minimum criteria for SD duration met, otherwise NE |
| NE | NE | NE |

CR = complete response;
PR = partial response;
SD = stable disease;
PD = progressive disease;
NE = inevaluable
*If CR is truly met at first time point, then any disease seen at a subsequent time point, even disease meeting PR criteria relative to baseline, makes the disease PD at that point (since disease must have reappeared after CR). Best response depends on whether minimum duration for SD is met. However, sometimes 'CR' is claimed when subsequent scans suggest small lesions were likely still present and in the fact patient had PR, not CR, at the first time point. Under these circumstances, the original CR is changed to PR and the best response is PR.

Confirmatory Measurements:

To be assigned a status of PR or CR, changes in tumor measurements is confirmed by repeat assessments that should be performed at least 4 weeks after the criteria for response are first met. In the case of SD, follow-up measurements must have met the SD criteria at least once after study entry at a minimum interval at 5 weeks.

Duration of Overall Response:

The duration of overall response is measured from the time measurement criteria are met for CR or PR (whichever is first recorded) until the first date that recurrent or progressive disease is objectively documented (taking as reference for progressive disease the smallest measurements recorded since the treatment started). The duration of overall CR is measured from the time measurement criteria are first met for CR until the first date that recurrent disease is objectively documented.

Duration of Stable Disease:

Stable disease is measured from the start of the treatment until the criteria for progression are met, taking as reference the smallest measurements recorded since the treatment started.

b. International Working Group Revised Response Criteria for Malignant Lymphoma (IWG) (2014)

The International working group revised response criteria for malignant lymphoma (IWG) (2014) follows the protocol described in "Recommendations for Initial Evaluation, Staging, and Response Assessment of Hodgkin and Non-Hodgkin Lymphoma—The Lugano Classification" Cheson, B. D., Fisher, R. I., Barrington, S. F., Cavalli, F., Schwartz, L. H., Zucca, E., Lister, T. A. (Sep. 20, 2014). Recommendations for Initial Evaluation, Staging, and Response Assessment of Hodgkin and Non-Hodgkin Lymphoma—The Lugano Classification. *Journal of Clinical Oncology:* 32(27), 3059-3067.

c. Response Assessment in Neuro-Oncology (RANO) Criteria

The Response assessment in neuro-oncology (RANO) criteria follows the protocol described in "Updated Response Assessment Criteria for High-Grade Gliomas: Response Assessment in Neuro-Oncology Working Group" Wen P Y, Macdonald D R, Reardon D A, Cloughesy T F, Sorensen A G, Galanis E, DeGroot J, Wick W, Gilbert M R, Lassman A B, Tsien C, Mikkelsen T, Wong E T, Chamberlain M C, Stupp R, Lamborn K R, Vogelbaum M A, van den Bent M J, Chang S M. Updated response assessment criteria for high-grade gliomas: Response Assessment in Neuro-Oncology Working Group. J Clin Oncol. 2010; 28(11):1963-72.

Figure 45:
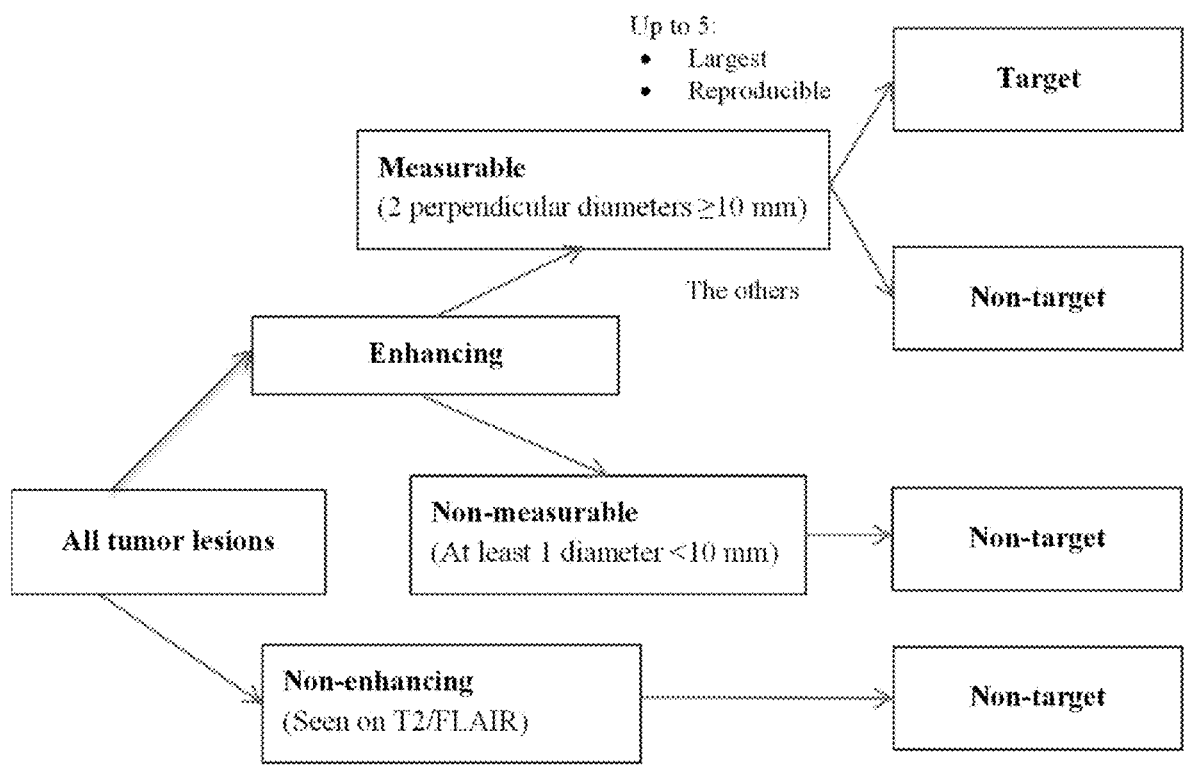
FIG. 45 shows the selection of target lesions using RANO criteria.

Selection of Target Lesions:

To evaluate changes in brain tumors using the RANO criteria, up to 5 enhancing lesions identified on baseline T1 (T1 relaxation time constant)-weighted images are measured and monitored for response over time. FIG. 45 shows the selection of target lesions using RANO criteria.

TABLE 32 summarizes response criteria:

TABLE 32

| Criterion | Complete Response | Partial Response | Stable Disease | Progressive Disease |
|---|---|---|---|---|
| T1 enhancing disease | None | ≥50% ↓ | <50% ↓ but <25% ↑ | ≥25% ↑[a] |
| T2/FLAIR | Stable or ↓ | Stable or ↓ | Stable or ↓ | ↑[a] |
| New lesion | None | None | None | Present[a] |
| Corticosteroids | None | Stable or ↓ | Stable or ↓ | NA[b] |
| Clinical status | Stable or ↑ | Stable or ↑ | Stable or ↑ | ↓[a] |
| Requirement for response | All | All | All | Any |

FLAIR, fluid-attenuated inversion recovery;
NA = not applicable
[a]Progression occurs when this criterion is present.
[b]Increase in corticosteroids alone are not be taken into account in determining progression in the absence of persistent clinical deterioration.

Figure 46:
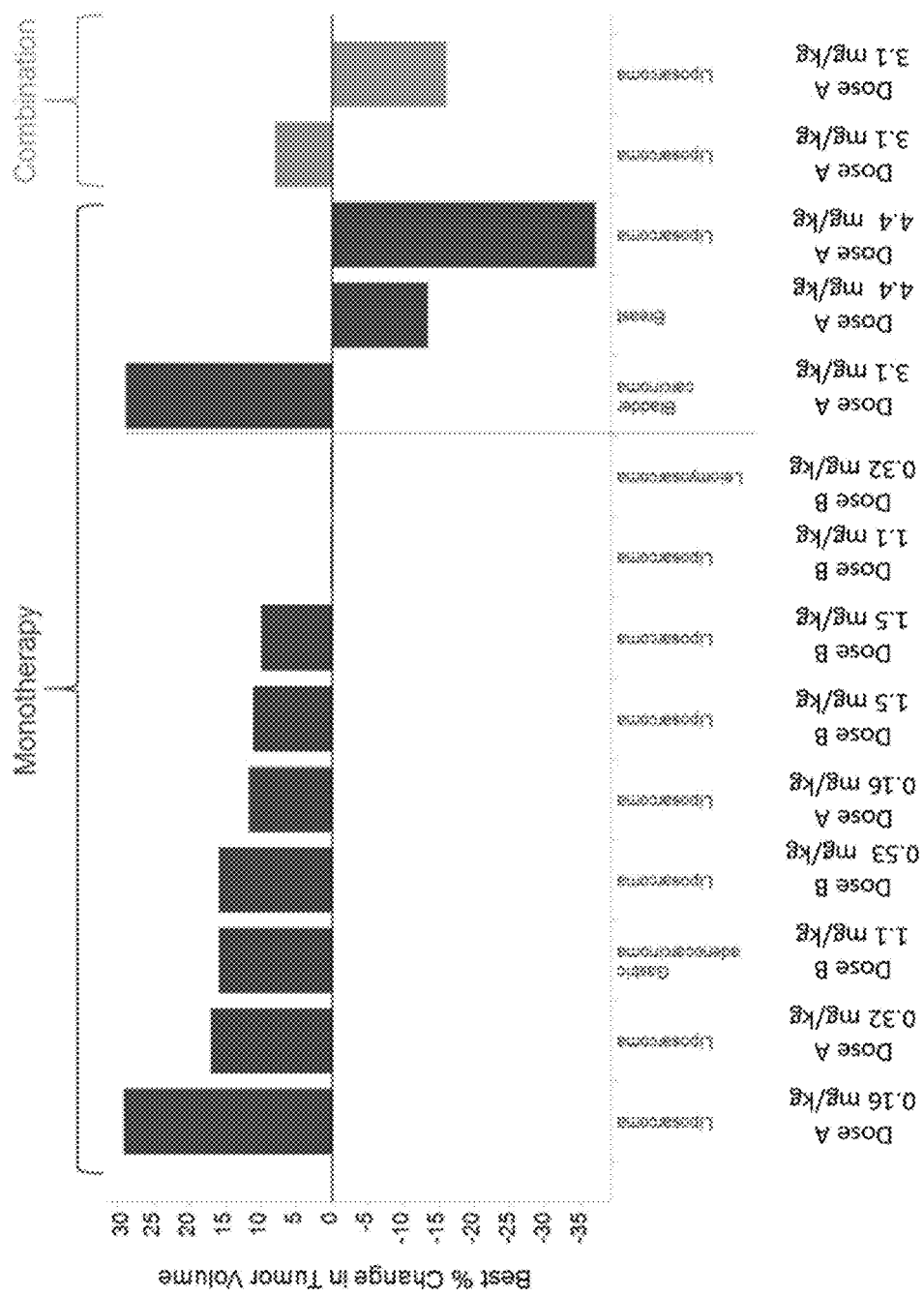
FIG. 46 shows the percent change of tumor volume in patients that received treatment with AP1 alone or in combination with palbociclib.

Example 33: Percent Change in Tumor Volume in Patients Treated with AP1 Alone or in Combination with Palbociclib Tumor bearing patients were treated with AP1 either alone or in combination with palbociclib. Patients receiving AP1 as a monotherapy were treated either once per week on days 1, 8, and 15 of a 28 day cycle (Dose A), or twice per week on days 1, 4, 8, and 11 of a 21 day cycle (Dose B) at various doses as shown in FIG. 46. Patients receiving AP1 in combination with palbociclib were treated with the Dose A regimen and also received 100 mg of palbociblib daily via oral administration. During treatment regiments the tumor volumes of patiens were measured and compared to baseline values. The best percent change seen in tumor volume for different patiens is shown in FIG. 46.

EMBODIMENTS

The following non-limiting embodiments provide illustrative examples of the disclosure, but do not limit the scope of the disclosure.

Embodiment 1

A method of treating a condition in a subject in need thereof, the method comprising administering to the subject a therapeutically-effective amount of a p53 activator and a therapeutically-effective amount of a cyclin dependent kinase inhibitor (CDKI), wherein the therapeutically-effective amount of the cyclin dependent kinase inhibitor is 1-250 mg.

Embodiment 2

The method of embodiment 1, wherein the p53 activator is a peptidomimetic macrocycle of the formula:

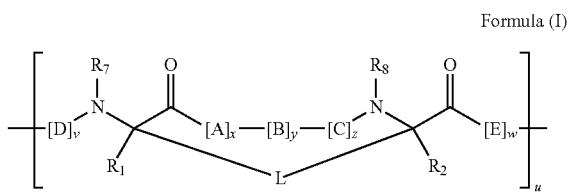

Formula (I)

or pharmaceutically acceptable salt thereof, wherein:
each A, C, D, and E is independently an amino acid;
each B is independently an amino acid,

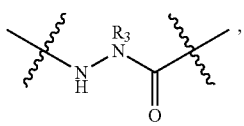

[—NH-L$_3$-CO—], [—NH-L$_3$-SO$_2$—], or [—NH-L$_3$-];
each R$_1$ and R$_2$ is independently hydrogen, alkyl, alkenyl, alkynyl, arylalkyl, cycloalkyl, cycloalkylalkyl, heteroalkyl, or heterocycloalkyl, unsubstituted or substituted with halo-; or forms a macrocycle-forming linker L' connected to the alpha position of one of said D or E amino acids;
each R$_3$ is independently hydrogen, alkyl, alkenyl, alkynyl, arylalkyl, heteroalkyl, cycloalkyl, heterocycloalkyl, cycloalkylalkyl, aryl, or heteroaryl, optionally substituted with R$_5$;
each L and L' is independently a macrocycle-forming linker of the formula -L$_1$-L$_2$-;
each L$_1$, L$_2$, and L$_3$ is independently alkylene, alkenylene, alkynylene, heteroalkylene, cycloalkylene, heterocycloalkylene, arylene, heteroarylene, or [—R$_4$—K—R$_4$-]$_n$, each being optionally substituted with R$_5$;
each R$_4$ is independently alkylene, alkenylene, alkynylene, heteroalkylene, cycloalkylene, heterocycloalkylene, arylene, or heteroarylene;
each K is independently O, S, SO, SO$_2$, CO, CO$_2$, or CONR$_3$;
each R$_5$ is independently halogen, alkyl, —OR$_6$, —N(R$_6$)$_2$, —SR$_6$, —SOR$_6$, —SO$_2$R$_6$, —CO$_2$R$_6$, a fluorescent moiety, a radioisotope or a therapeutic agent;
each R$_6$ is independently hydrogen, alkyl, alkenyl, alkynyl, arylalkyl, cycloalkylalkyl, heterocycloalkyl, a fluorescent moiety, a radioisotope or a therapeutic agent;
each R$_7$ is independently hydrogen, alkyl, alkenyl, alkynyl, arylalkyl, cycloalkyl, heteroalkyl, cycloalkylalkyl, heterocycloalkyl, aryl, or heteroaryl, optionally substituted with R$_5$, or part of a cyclic structure with a D residue;
each R$_8$ is independently hydrogen, alkyl, alkenyl, alkynyl, arylalkyl, cycloalkyl, heteroalkyl, cycloalkylalkyl, heterocycloalkyl, aryl, or heteroaryl, optionally substituted with R$_5$, or part of a cyclic structure with an E residue;
each v is independently an integer from 1-1000;
each w is independently an integer from 1-1000;
u is 1, 2, 3, 4, 5, 6, 7, 8, 9, or 10;
each x, y and z is independently 1, 2, 3, 4, 5, 6, 7, 8, 9, or 10; and
each n is independently 1, 2, 3, 4, or 5.

Embodiment 3

The method of embodiment 2, wherein v is 3-10.

Embodiment 4

The method of embodiment 2, wherein v is 3.

Embodiment 5

The method of any one of embodiments 2-4, wherein w is 3-10.

Embodiment 6

The method of any one of embodiments 2-4, wherein w is 6.

Embodiment 7

The method of any one of embodiments 2-6, wherein x+y+z=6.

Embodiment 8

The method of any one of embodiments 2-7, wherein each L$_1$ and L$_2$ is independently alkylene, alkenylene, alkynylene, heteroalkylene, cycloalkylene, heterocycloalkylene, arylene, or heteroarylene.

Embodiment 9

The method of any one of embodiments 2-7, wherein each L$_1$ and L$_2$ is independently alkylene or alkenylene.

Embodiment 10

The method of any one of embodiments 2-9, wherein each R$_1$ and R$_2$ is independently hydrogen, alkyl, alkenyl, alkynyl, arylalkyl, cycloalkyl, cycloalkylalkyl, heteroalkyl, or heterocycloalkyl, unsubstituted or substituted with halo-.

Embodiment 11

The method of any one of embodiments 2-9, wherein each R$_1$ and R$_2$ is independently hydrogen.

Embodiment 12

The method of any one of embodiments 2-9, wherein each R$_1$ and R$_2$ is independently alkyl.

Embodiment 13

The method of any one of embodiments 2-9, wherein each R$_1$ and R$_2$ is independently methyl.

Embodiment 14

The method of any one of embodiments 2-13, wherein u is 1.

Embodiment 15

The method of any one of embodiments 2-14, wherein each E is Ser or Ala, or d-Ala.

Embodiment 16

The method of any one of embodiments 2-15, wherein the peptidomimetic macrocycle comprises an amino acid sequence that is at least 60% identical to an amino acid sequence listed in Table 1, Table 1a, Table 1b, Table 1c, Table 2a, or Table 2b.

Embodiment 17

The method of any one of embodiments 2-15, wherein the peptidomimetic macrocycle comprises an amino acid sequence that is at least 70% identical to an amino acid sequence listed in Table 1, Table 1a, Table 1b, Table 1c, Table 2a, or Table 2b.

Embodiment 18

The method of any one of embodiments 2-15, wherein the peptidomimetic macrocycle comprises an amino acid sequence that is at least 80% identical to an amino acid sequence listed in Table 1, Table 1a, Table 1b, Table 1c, Table 2a, or Table 2b.

Embodiment 19

The method of any one of embodiments 2-15, wherein the peptidomimetic macrocycle is at least 60% identical to SP-153, SP-303, SP-331, or SP-671.

Embodiment 20

The method of any one of embodiments 1-19, wherein the p53 activator antagonizes an interaction between p53 and MDM2.

Embodiment 21

The method of any one of embodiments 1-20, wherein the p53 activator antagonizes an interaction between p53 and MDMX.

Embodiment 22

The method of any one of embodiments 1-21, wherein the p53 activator antagonizes an interaction between p53 and MDM2 and antagonizes an interaction between p53 and MDMX.

Embodiment 23

The method of any one of embodiments 1-22, wherein the p53 activator and the CDKI synergize.

Embodiment 24

The method of any one of embodiments 1-23, wherein the therapeutically-effective amount of the p53 activator is less than is a therapeutically-effective amount of the p53 activator in the absence of the CDKI.

Embodiment 25

The method of any one of embodiments 1-24, wherein the therapeutically-effective amount of the CDKI is less than is a therapeutically-effective amount of the CDKI in the absence of the p53 activator.

Embodiment 26

The method of any one of embodiments 1-25, wherein the p53 activator reduces a side effect associated with the CDKI.

Embodiment 27

The method of embodiment 26, wherein the side effect is toxicity.

Embodiment 28

The method of embodiment 26, wherein the side effect is neutropenia.

Embodiment 29

The method of any one of embodiments 1-28, wherein the subject has a tumor with wildtype TP53.

Embodiment 30

The method of any one of embodiments 1-29, wherein the subject has a MDM2 amplified tumor.

Embodiment 31

The method of any one of embodiments 1-30, wherein the subject has a CDK4 amplified tumor.

Embodiment 32

The method of any one of embodiments 1-31, wherein the subject has a MDM2/CDK4 co-amplified tumor.

Embodiment 33

The method of any one of embodiments 1-32, wherein the CDKI inhibits cyclin dependent kinase 4.

Embodiment 34

The method of any one of embodiments 1-33, wherein the CDKI binds to cyclin dependent kinase 4.

Embodiment 35

The method of any one of embodiments 1-34, wherein the CDKI inhibits cyclin dependent kinase 6.

Embodiment 36

The method of any one of embodiments 1-35, wherein the CDKI binds to cyclin dependent kinase 6.

Embodiment 37

The method of any one of embodiments 1-36, wherein the CDKI inhibits cyclin dependent kinase 7.

Embodiment 38

The method of any one of embodiments 1-37, wherein the CDKI binds to cyclin dependent kinase 7.

Embodiment 39

The method of any one of embodiments 1-38, wherein the CDKI inhibits cyclin dependent kinase 9.

Embodiment 40

The method of any one of embodiments 1-39, wherein the CDKI binds to cyclin dependent kinase 9.

Embodiment 41

The method of any one of embodiments 1-40, wherein the CDKI inhibitor and the p53 activator are administered concurrently.

Embodiment 42

The method of any one of embodiments 1-40, wherein, the CDKI inhibitor and the p53 activator are administered sequentially.

Embodiment 43

The method of any one of embodiments 1-42, wherein the p53 activator is administered via intravenous infusion.

Embodiment 44

The method of embodiment 43, wherein the administration via intravenous infusion occurs over a period of time of about 1 hour.

Embodiment 45

The method of any one of embodiments 1-44, wherein the CDKI is administered orally.

Embodiment 46

The method of any one of embodiments 1-40 or 42-46, wherein the CDKI is administered at least 6 hours after the administration of the p53 activator.

Embodiment 47

The method of any one of embodiments 1-46, wherein the p53 activator and the CDKI are administered during a 28 day cycle, wherein the administration of the CDKI occurs once per day on days 1-21 of the 28 day treatment cycle; and the administration of the p53 activator is on days 1, 8, and 15 of the 28 day cycle.

Embodiment 48

The method of any one of embodiments 1-47, wherein the therapeutically-effective amount of the p53 activator is about 0.01-about 100 mg per kg of body weight of the subject.

Embodiment 49

The method of any one of embodiments 1-48, wherein the therapeutically-effective amount of the p53 activator is about 1-about 10 mg per kg of body weight of the subject.

Embodiment 50

The method of any one of embodiments 1-49, wherein the therapeutically-effective amount of the CDKI is 75 mg.

Embodiment 51

The method of any one of embodiments 1-49, wherein the therapeutically-effective amount of the CDKI is 100 mg.

Embodiment 52

The method of any one of embodiments 1-49, wherein the therapeutically-effective amount of the CDKI is 125 mg.

Embodiment 53

The method of any one of embodiments 1-52, wherein the p53 activator is administered as part of a pharmaceutical composition, wherein the pharmaceutical composition comprises the p53 activator and trehalose.

Embodiment 54

The method of any one of embodiments 1-53, wherein the CDKI is palbociclib.

Embodiment 55

The method of any one of embodiments 1-53, wherein the CDKI is abemaciclib.

Embodiment 56

The method of any one of embodiments 1-53, wherein the CDKI is seliciclib.

Embodiment 57

The method of any one of embodiments 1-53, wherein the CDKI is ribociclib.

Embodiment 58

The method of any one of embodiments 1-53, wherein the CDKI is trilaciclib.

Embodiment 59

The method of any one of embodiments 1-53, wherein the CDKI is seliciclib.

Embodiment 60

The method of any one of embodiments 1-53, wherein the CDKI is dinaciclib.

Embodiment 61

The method of any one of embodiments 1-53, wherein the CDKI is milciclib.

Embodiment 62

The method of any one of embodiments 1-53, wherein the CDKI is roniciclib.

Embodiment 63

The method of any one of embodiments 1-53, wherein the CDKI is atuveciclib.

Embodiment 64

The method of any one of embodiments 1-53, wherein the CDKI is briciclib.

Embodiment 65

The method of any one of embodiments 1-53, wherein the CDKI is riviciclib.

Embodiment 66

The method of any one of embodiments 1-53, wherein the CDKI is voruciclib.

Embodiment 67

A method of treating a condition in a subject in need thereof, the method comprising administering to the subject: a) a pharmaceutical composition, wherein the pharmaceutical composition comprises a therapeutically-effective amount of a p53 activator and trehalose; and b) a therapeutically-effective amount of a cyclin dependent kinase inhibitor (CDKI).

Embodiment 68

The method of embodiment 67, wherein the p53 activator is a peptidomimetic macrocycle of the formula:

Formula (I)

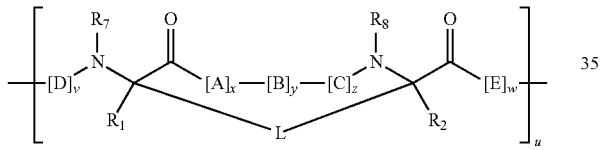

or pharmaceutically acceptable salt thereof, wherein:
each A, C, D, and E is independently an amino acid;
each B is independently an amino acid,

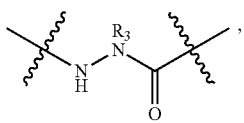

[—NH-$L_3$-CO—], [—NH-$L_3$-$SO_2$—], or [—NH-$L_3$-];
each $R_1$ and $R_2$ is independently hydrogen, alkyl, alkenyl, alkynyl, arylalkyl, cycloalkyl, cycloalkylalkyl, heteroalkyl, or heterocycloalkyl, unsubstituted or substituted with halo-; or forms a macrocycle-forming linker L' connected to the alpha position of one of said D or E amino acids;
each $R_3$ is independently hydrogen, alkyl, alkenyl, alkynyl, arylalkyl, heteroalkyl, cycloalkyl, heterocycloalkyl, cycloalkylalkyl, aryl, or heteroaryl, optionally substituted with $R_5$;
each L and L' is independently a macrocycle-forming linker of the formula -$L_1$-$L_2$-;
each $L_1$, $L_2$, and $L_3$ is independently alkylene, alkenylene, alkynylene, heteroalkylene, cycloalkylene, heterocycloalkylene, arylene, heteroarylene, or [—$R_4$—K—$R_4$-]$_n$, each being optionally substituted with $R_5$;
each $R_4$ is independently alkylene, alkenylene, alkynylene, heteroalkylene, cycloalkylene, heterocycloalkylene, arylene, or heteroarylene;
each K is independently O, S, SO, $SO_2$, CO, $CO_2$, or $CONR_3$;
each $R_5$ is independently halogen, alkyl, —$OR_6$, —N($R_6$)$_2$, —$SR_6$, —$SOR_6$, —$SO_2R_6$, —$CO_2R_6$, a fluorescent moiety, a radioisotope or a therapeutic agent;
each $R_6$ is independently hydrogen, alkyl, alkenyl, alkynyl, arylalkyl, cycloalkylalkyl, heterocycloalkyl, a fluorescent moiety, a radioisotope or a therapeutic agent;
each $R_7$ is independently hydrogen, alkyl, alkenyl, alkynyl, arylalkyl, cycloalkyl, heteroalkyl, cycloalkylalkyl, heterocycloalkyl, aryl, or heteroaryl, optionally substituted with $R_5$, or part of a cyclic structure with a D residue;
each $R_8$ is independently hydrogen, alkyl, alkenyl, alkynyl, arylalkyl, cycloalkyl, heteroalkyl, cycloalkylalkyl, heterocycloalkyl, aryl, or heteroaryl, optionally substituted with $R_5$, or part of a cyclic structure with an E residue;
each v is independently an integer from 1-1000;
each w is independently an integer from 1-1000;
u is 1, 2, 3, 4, 5, 6, 7, 8, 9, or 10;
each x, y and z is independently 1, 2, 3, 4, 5, 6, 7, 8, 9, or 10; and
each n is independently 1, 2, 3, 4, or 5.

Embodiment 69

The method of embodiment 68, wherein v is 3-10.

Embodiment 70

The method of embodiment 68, wherein v is 3.

Embodiment 71

The method of any one of embodiments 68-70, wherein w is 3-10.

Embodiment 72

The method of any one of embodiments 68-70, wherein w is 6.

Embodiment 73

The method of any one of embodiments 68-72, wherein x+y+z=6.

Embodiment 74

The method of any one of embodiments 68-73, wherein each $L_1$ and $L_2$ is independently alkylene, alkenylene, alkynylene, heteroalkylene, cycloalkylene, heterocycloalkylene, arylene, or heteroarylene.

Embodiment 75

The method of any one of embodiments 68-73, wherein each $L_1$ and $L_2$ is independently alkylene or alkenylene.

Embodiment 76

The method of any one of embodiments 68-75, wherein each $R_1$ and $R_2$ is independently hydrogen, alkyl, alkenyl, alkynyl, arylalkyl, cycloalkyl, cycloalkylalkyl, heteroalkyl, or heterocycloalkyl, unsubstituted or substituted with halo-.

Embodiment 77

The method of any one of embodiments 68-75, wherein each $R_1$ and $R_2$ is independently hydrogen.

Embodiment 78

The method of any one of embodiments 68-75, wherein each $R_1$ and $R_2$ is independently alkyl.

Embodiment 79

The method of any one of embodiments 68-75, wherein each $R_1$ and $R_2$ is independently methyl.

Embodiment 80

The method of any one of embodiments 68-79, wherein u is 1.

Embodiment 81

The method of any one of embodiments 68-80, wherein each E is Ser or Ala, or d-Ala.

Embodiment 82

The method of any one of embodiments 68-81, wherein the peptidomimetic macrocycle comprises an amino acid sequence that is at least 60% identical to an amino acid sequence listed in Table 1, Table 1a, Table 1b, Table 1c, Table 2a, or Table 2b.

Embodiment 83

The method of any one of embodiments 68-81, wherein the peptidomimetic macrocycle comprises an amino acid sequence that is at least 70% identical to an amino acid sequence listed in Table 1, Table 1a, Table 1b, Table 1c, Table 2a, or Table 2b.

Embodiment 84

The method of any one of embodiments 68-81, wherein the peptidomimetic macrocycle comprises an amino acid sequence that is at least 80% identical to an amino acid sequence listed in Table 1, Table 1a, Table 1b, Table 1c, Table 2a, or Table 2b.

Embodiment 85

The method of any one of embodiments 68-81, wherein the peptidomimetic macrocycle is at least 60% identical to SP-153, SP-303, SP-331, or SP-671.

Embodiment 86

The method of any one of embodiments 67-85, wherein the p53 activator antagonizes an interaction between p53 and MDM2.

Embodiment 87

The method of any one of embodiments 67-86, wherein the p53 activator antagonizes an interaction between p53 and MDMX.

Embodiment 88

The method of any one of embodiments 67-87, wherein the p53 activator antagonizes an interaction between p53 and MDM2 and antagonizes an interaction between p53 and MDMX.

Embodiment 89

The method of any one of embodiments 67-88, wherein the p53 activator and the CDKI synergize.

Embodiment 90

The method of any one of embodiments 67-89, wherein the therapeutically-effective amount of the p53 activator is less than is a therapeutically-effective amount of the p53 activator in the absence of the CDKI.

Embodiment 91

The method of any one of embodiments 67-90, wherein the therapeutically-effective amount of the CDKI is less than is a therapeutically-effective amount of the CDKI in the absence of the pharmaceutical composition.

Embodiment 92

The method of any one of embodiments 67-91, wherein the p53 activator reduces a side effect associated with the CDKI.

Embodiment 93

The method of embodiment 92, wherein the side effect is toxicity.

Embodiment 94

The method of embodiment 92, wherein the side effect is neutropenia.

Embodiment 95

The method of any one of embodiments 67-94, wherein the subject has a tumor with wildtype TP53.

Embodiment 96

The method of any one of embodiments 67-95, wherein the subject has a MDM2 amplified tumor.

Embodiment 97

The method of any one of embodiments 67-96, wherein the subject has a CDK4 amplified tumor.

Embodiment 98

The method of any one of embodiments 67-97, wherein the subject has a MDM2/CDK4 co-amplified tumor.

Embodiment 99

The method of any one of embodiments 67-98, wherein the CDKI inhibits cyclin dependent kinase 4.

Embodiment 100

The method of any one of embodiments 67-99, wherein the CDKI binds to cyclin dependent kinase 4.

Embodiment 101

The method of any one of embodiments 67-100, wherein the CDKI inhibits cyclin dependent kinase 6.

Embodiment 102

The method of any one of embodiments 67-101, wherein the CDKI binds to cyclin dependent kinase 6.

Embodiment 103

The method of any one of embodiments 67-102, wherein the CDKI inhibits cyclin dependent kinase 7.

Embodiment 104

The method of any one of embodiments 67-103, wherein the CDKI binds to cyclin dependent kinase 7.

Embodiment 105

The method of any one of embodiments 67-104, wherein the CDKI inhibits cyclin dependent kinase 9.

Embodiment 106

The method of any one of embodiments 67-105, wherein the CDKI binds to cyclin dependent kinase 9.

Embodiment 107

The method of any one of embodiments 67-106, wherein CDKI is administered as part of the pharmaceutical composition.

Embodiment 108

The method of any one of embodiments 67-106, wherein the CDKI inhibitor is administered in a separate pharmaceutical composition.

Embodiment 109

The method of any one of embodiments 67-108, wherein the CDKI inhibitor and the pharmaceutical composition are administered concurrently.

Embodiment 110

The method of any one of embodiments 67-106 or 108, wherein the CDKI inhibitor and the pharmaceutical composition are administered sequentially.

Embodiment 111

The method of any one of embodiments 67-110, wherein the p53 activator is administered via intravenous infusion.

Embodiment 112

The method of embodiment 111, wherein the administration via intravenous infusion occurs over a period of time of about 1 hour.

Embodiment 113

The method of any one of embodiments 67-112, wherein the CDKI is administered orally.

Embodiment 114

The method of any one of embodiments 67-106, 108, or 110-113, wherein the CDKI is administered at least 6 hours after the administration of the p53 activator.

Embodiment 115

The method of any one of embodiments 67-114, wherein the p53 activator and the CDKI are administered during a 28 day cycle, wherein the administration of the CDKI occurs once per day on days 1-21 of the 28 day treatment cycle; and the administration of the p53 activator is on days 1, 8, and 15 of the 28 day cycle.

Embodiment 116

The method of any one of embodiments 67-115, wherein the CDKI is palbociclib.

Embodiment 117

The method of any one of embodiments 67-115, wherein the CDKI is abemaciclib.

Embodiment 118

The method of any one of embodiments 67-115, wherein the CDKI is seliciclib.

Embodiment 119

The method of any one of embodiments 67-115, wherein the CDKI is ribociclib.

Embodiment 120

The method of any one of embodiments 67-115, wherein the CDKI is trilaciclib.

Embodiment 121

The method of any one of embodiments 67-115, wherein the CDKI is seliciclib.

Embodiment 122

The method of any one of embodiments 67-115, wherein the CDKI is dinaciclib.

Embodiment 123

The method of any one of embodiments 67-115, wherein the CDKI is milciclib.

Embodiment 124

The method of any one of embodiments 67-115, wherein the CDKI is roniciclib.

Embodiment 125

The method of any one of embodiments 67-115, wherein the CDKI is atuveciclib.

Embodiment 126

The method of any one of embodiments 67-115, wherein the CDKI is briciclib.

Embodiment 127

The method of any one of embodiments 67-115, wherein the CDKI is riviciclib.

Embodiment 128

The method of any one of embodiments 67-115, wherein the CDKI is voruciclib.

Embodiment 129

A method of treating a condition in a subject in need thereof, the method comprising administering to the subject a therapeutically-effective amount of a p53 activator and a therapeutically-effective amount of cyclin dependent kinase inhibitor (CDKI), wherein:
  a) the therapeutically-effective amount of the CDKI is 1-250 mg; and
  b) when, in a controlled study, a treatment regimen comprising:
    i) 20 mg per kilogram of body weight of the p53 activator administered once per week during a 22 day period; and
    ii) 75 mg per kilogram of body weight of the CDKI administered once per day during the 22 day period;
is administered to each mouse of a group of 10 mice, wherein each mouse has a MCF-7 tumor, median growth of the MCF-7 tumors in the group of 10 mice occurs with at most a 30% deviation from line 4 or 5 as in FIG. 32.

Embodiment 130

The method of embodiment 129, wherein the CDKI is palbociclib.

Embodiment 131

A method of treating a condition in a subject in need thereof, the method comprising administering to the subject a therapeutically-effective amount of a p53 activator and a therapeutically-effective amount of cyclin dependent kinase inhibitor (CDKI), wherein:
  a) the therapeutically-effective amount of the CDKI is 1-250 mg; and
  b) when, in a controlled study, a treatment regimen comprising:
    i) 20 mg per kilogram of body weight of the p53 activator administered once per week during a 22 day period; and
    ii) 75 mg per kilogram of body weight of the CDKI administered once per day during the 22 day period;
is administered to each mouse of a group 10 mice, wherein each mouse has a SJSA-1 tumor, median growth of the SJSA-1 tumors in the group of 10 mice occurs with at most a 30% deviation from line 4 or 5 as illustrated in FIG. 33:

Embodiment 132

The method of embodiment 131, wherein the CDKI is palbociclib.

Embodiment 133

A method of treating a condition in a subject in need thereof, the method comprising administering to the subject a therapeutically-effective amount of a p53 activator and a therapeutically-effective amount of cyclin dependent kinase inhibitor (CDKI), wherein:
  a) the therapeutically-effective amount of the CDKI is 1-250 mg; and
  b) when, in a controlled study a treatment regimen comprising:
    i) 20 mg per kilogram of body weight of a p53 activator administered twice per week for a 22 day period;
    ii) 100 mg per kilogram of body weight of a CDKI administered once per day on days 1-14 of the 22 day period; and
    iii) 75 mg per kilogram of body weight of a CDKI administered once per day on days 18-22 of the 22 day period;
is administered to each mouse of a group of 8-10 mice, wherein each mouse has a MCF-7 tumor, median growth of the MCF-7 tumors in the group of 8-10 mice occurs with at most a 30% deviation from line 3 as illustrated in FIG. 36.

Embodiment 134

The method of embodiment 133, wherein the CDKI is abemaciclib.

Embodiment 135

A method of treating a condition in a subject in need thereof, the method comprising administering to the subject a therapeutically-effective amount of a p53 activator and a therapeutically-effective amount of cyclin dependent kinase inhibitor (CDKI), wherein:
  a) the therapeutically-effective amount of the CDKI is 1-250 mg; and
  b) when, in a controlled study, a treatment regimen comprising:
    i) 10 mg per kilogram of body weight of a p53 activator administered twice per week for a 22 day period;
    ii) 100 mg per kilogram of body weight of a CDKI administered once per day on days 1-14 of the 22 day period; and
    iii) 75 mg per kilogram of body weight of a CDKI administered once per day on days 18-22 of the 22 day period;
is administered to each mouse of a group of 8-10 mice, wherein each mouse has a MCF-7 tumor, median growth of the MCF-7 tumors in the group of 8-10 mice occurs with at most a 30% deviation from line 5 as illustrated in FIG. 36.

Embodiment 136

The method of embodiment 135, wherein the CDKI is abemaciclib.

Embodiment 137

A method of treating a subject with a tumor, the method comprising administering to the subject a therapeutically-effective amount of a p53 activator and a therapeutically-effective amount of cyclin dependent kinase inhibitor (CDKI), wherein:
  a) the therapeutically-effective amount of the CDKI is 1-250 mg; and
  b) when, in a controlled study, a treatment regimen comprising:
   i) 20 mg per kilogram of body weight of a p53 activator administered twice per week for a 22 day period;
   ii) 100 mg per kilogram of body weight of a CDKI administered once per day on days 1-14 of the 22 day period; and
   iii) 75 mg per kilogram of body weight of a CDKI administered once per day on days 18-22 of the 22 day period;
is administered to each mouse of a group of 8-10 mice, wherein each mouse has a MCF-7 tumor, the group of 8-10 mice generate a survival curve with at most 30% deviation from line 3 as illustrated in FIG. 37.

Embodiment 138

The method of embodiment 137, wherein the CDKI is abemaciclib.

Embodiment 139

A method of treating a subject with a tumor, the method comprising administering to the subject a therapeutically-effective amount of a p53 activator and a therapeutically-effective amount of cyclin dependent kinase inhibitor (CDKI), wherein:
  a) the therapeutically-effective amount of the CDKI is 1-250 mg; and
  b) when, in a controlled study, a treatment regimen comprising:
   i) 10 mg per kilogram of body weight of a p53 activator administered twice per week for a 22 day period;
   ii) 100 mg per kilogram of body weight of a CDKI administered once per day on days 1-14 of the 22 day period; and
   iii) 75 mg per kilogram of body weight of a CDKI administered once per day on days 18-22 of the 22 day period;
is administered to each mouse of a group of 8-10 mice, wherein each mouse has a MCF-7 tumor, the group of 8-10 mice generate a survival curve with at most 30% deviation from line 5 as illustrated in FIG. 37.

Embodiment 140

The method of embodiment 139, wherein the CDKI is abemaciclib.

Embodiment 141

A method of treating a subject with a tumor, the method comprising administering to the subject a therapeutically-effective amount of a p53 activator and a therapeutically-effective amount of cyclin dependent kinase inhibitor (CDKI), wherein:
  a) the therapeutically-effective amount of the CDKI is 1-250 mg; and
  b) when, in a controlled study, a treatment regimen comprising:
   i) 20 mg per kilogram of body weight of the p53 activator administered twice per week during a 22 day period; and
   ii) 75 mg per kilogram of body weight of the CDKI administered once per day during the 22 day period;
is administered to each mouse of a group of 10 mice, wherein each mouse has a MCF-7 tumor, median growth of the MCF-7 tumors in the group of 10 mice occurs with at most a 30% deviation from line 4 as illustrated in FIG. 38.

Embodiment 142

The method of embodiment 141, wherein the CDKI is ribociclib.

Embodiment 143

A method of treating a subject with a tumor, the method comprising administering to the subject a therapeutically-effective amount of a p53 activator and a therapeutically-effective amount of cyclin dependent kinase inhibitor (CDKI), wherein:
  a) the therapeutically-effective amount of the CDKI is 1-250 mg; and
  b) when, in a controlled study, a treatment regimen comprising:
   i) 10 mg per kilogram of body weight of the p53 activator administered twice per week during a 22 day period; and
   ii) 75 mg per kilogram of body weight of the CDKI administered once per day during the 22 day period;
is administered to each mouse of a group of 10 mice, wherein each mouse has a MCF-7 tumor, median growth of the MCF-7 tumors in the group of 10 mice occurs with at most a 30% deviation from line 5 as illustrated in FIG. 38.

Embodiment 144

The method of embodiment 143, wherein the CDKI is ribociclib.

Embodiment 145

A method of treating a subject with a tumor, the method comprising administering to the subject a therapeutically-effective amount of a p53 activator and a therapeutically-effective amount of cyclin dependent kinase inhibitor (CDKI), wherein:
  a) the therapeutically-effective amount of the CDKI is 1-250 mg; and
  b) when, in a controlled study, a treatment regimen comprising:
   i) 20 mg per kilogram of body weight of the p53 activator administered twice per week during a 22 day period; and
   ii) 75 mg per kilogram of body weight of the CDKI administered once per day during the 22 day period;
is administered to each mouse of a group of 10 mice, wherein each mouse has a MCF-7 tumor, the group of 10 mice generate a survival curve with at most a 30% deviation from line 4 as illustrated in FIG. 39.

Embodiment 146

The method of embodiment 145, wherein the CDKI is ribociclib.

Embodiment 147

A method of treating a subject with a tumor, the method comprising administering to the subject a therapeutically-effective amount of a p53 activator and a therapeutically-effective amount of cyclin dependent kinase inhibitor (CDKI), wherein:
  a) the therapeutically-effective amount of the CDKI is 1-250 mg; and
  b) when, in a controlled study, a treatment regimen comprising:
    i) 10 mg per kilogram of body weight of the p53 activator administered twice per week during a 22 day period; and
    ii) 75 mg per kilogram of body weight of the CDKI administered once per day during the 22 day period;
  is administered to each mouse of a group of 10 mice, wherein each mouse has a MCF-7 tumor, the group of 10 mice generate a survival curve with at most a 30% deviation from line 5 as illustrated in FIG. 39.

Embodiment 148

The method of embodiment 147, wherein the CDKI is ribociclib.

Embodiment 149

A method of treating a subject with a tumor, the method comprising administering to the subject a therapeutically-effective amount of a p53 activator and a therapeutically-effective amount of cyclin dependent kinase inhibitor (CDKI), wherein:
  a) the therapeutically-effective amount of the CDKI is 1-250 mg; and
  b) when, in a controlled study, a treatment regimen comprising:
    i) 20 mg per kilogram of body weight of the p53 activator administered twice per week during a 22 day period; and
    ii) 75 mg per kilogram of body weight of the CDKI administered once per day during the 22 day period;
  is administered to each mouse of a group of 10 mice, wherein each mouse has a MCF-7 tumor, median growth of the MCF-7 tumors in the group of 10 mice occurs with at most a 30% deviation from line 4 as illustrated in FIG. 34.

Embodiment 150

The method of embodiment 149, wherein the CDKI is palbociclib.

Embodiment 151

A method of treating a subject with a tumor, the method comprising administering to the subject a therapeutically-effective amount of a p53 activator and a therapeutically-effective amount of cyclin dependent kinase inhibitor (CDKI), wherein:
  a) the therapeutically-effective amount of the CDKI is 1-250 mg; and
  b) when, in a controlled study, a treatment regimen comprising:
    i) 10 mg per kilogram of body weight of the p53 activator administered twice per week during a 22 day period; and
    ii) 75 mg per kilogram of body weight of the CDKI administered once per day during the 22 day period;
  is administered to each mouse of a group of 10 mice, wherein each mouse has a MCF-7 tumor, median growth of the MCF-7 tumors in the group of 10 mice occurs with at most a 30% deviation from line 5 as illustrated in FIG. 34.

Embodiment 152

The method of embodiment 151, wherein the CDKI is palbociclib.

Embodiment 153

A method of treating a subject with a tumor, the method comprising administering to the subject a therapeutically-effective amount of a p53 activator and a therapeutically-effective amount of cyclin dependent kinase inhibitor (CDKI), wherein:
  a) the therapeutically-effective amount of the CDKI is 1-250 mg; and
  b) when, in a controlled study, a treatment regimen comprising:
    i) 20 mg per kilogram of body weight of the p53 activator administered twice per week during a 22 day period; and
    ii) 75 mg per kilogram of body weight of the CDKI administered once per day during the 22 day period;
  is administered to each mouse of a group of 10 mice, wherein each mouse has a MCF-7 tumor, the group of 10 mice generate a survival curve with at most a 30% deviation from line 4 as illustrated in FIG. 35.

Embodiment 154

The method of embodiment 153, wherein the CDKI is palbociclib.

Embodiment 155

A method of treating a subject with a tumor, the method comprising administering to the subject a therapeutically-effective amount of a p53 activator and a therapeutically-effective amount of cyclin dependent kinase inhibitor (CDKI), wherein:
  a) the therapeutically-effective amount of the CDKI is 1-250 mg; and
  b) when, in a controlled study, a treatment regimen comprising:
    i) 10 mg per kilogram of body weight of the p53 activator administered twice per week during a 22 day period; and ii) 75 mg per kilogram of body weight of the CDKI administered once per day during the 22 day period;

is administered to each mouse of a group of 10 mice, wherein each mouse has a MCF-7 tumor, the group of 10 mice generate a survival curve with at most a 30% deviation from line 5 as illustrated in FIG. 35.

Embodiment 156

The method of embodiment 155, wherein the CDKI is palbociclib.

Embodiment 157

A method of treating a subject with a tumor, the method comprising administering to the subject a therapeutically-effective amount of a p53 activator and a therapeutically-effective amount of cyclin dependent kinase inhibitor (CDKI), wherein:
a) the therapeutically-effective amount of the CDKI is 1-250 mg; and
b) when, in a controlled study, a treatment regimen comprising:
i) 20 mg per kilogram of body weight of the p53 activator administered twice per week during a 22 day period; and
ii) 75 mg per kilogram of body weight of the CDKI administered once per day during the 22 day period;
is administered to each mouse of a group of 10 mice, wherein each mouse has a SJSA-1 tumor, median growth of the SJSA-1 tumors in the group of 10 mice occurs with at most a 30% deviation from line 4 or 5 as illustrated in FIG. 41.

Embodiment 158

The method of embodiment 157, wherein the CDKI is palbociclib.

Embodiment 159

A method of treating a subject with a tumor, the method comprising administering to the subject a therapeutically-effective amount of a p53 activator and a therapeutically-effective amount of cyclin dependent kinase inhibitor (CDKI), wherein:
a) the therapeutically-effective amount of the CDKI is 1-250 mg; and
b) when, in a controlled study, a treatment regimen comprising:
i) 20 mg per kilogram of body weight of the p53 activator administered twice per week during a 22 day period; and
ii) 75 mg per kilogram of body weight of the CDKI administered once per day during the 22 day period;
is administered to each mouse of a group of 10 mice, wherein each mouse has a SJSA-1 tumor, the group of 10 mice generate a survival curve with at most a 30% deviation from line 4 or line 5 as illustrated in FIG. 42.

Embodiment 160

The method of embodiment 159, wherein the CDKI is palbociclib.

---

SEQUENCE LISTING (1948 sequences)

SEQ ID NO: 1 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAAA

SEQ ID NO: 2 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (11)..(11): 2-aminoisobutyric acid
  C-term NH2
FAAYWEXLAAXA

SEQ ID NO: 3 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLASAL

SEQ ID NO: 4 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASAL

SEQ ID NO: 5 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASAM

SEQ ID NO: 6 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): hLeu
  C-term NH2
LTFAAYWAQLASAL

SEQ ID NO: 7 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASAF

SEQ ID NO: 8 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASAI

SEQ ID NO: 9 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Cyclohexyl-Gly
  C-term NH2
LTFAAYWAQLASAG

SEQ ID NO: 10 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
LTFAAYWAQLASAX

SEQ ID NO: 11 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 12 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(9): Crosslink between residues
  MOD_RES (9)..(9): Alpha-Me S5-pentenyl-alanine olefin amino acid connected by an all-carbon crosslinker comprising one double bond
  MOD_RES (11)..(11): Alpha-Me S5-pentenyl-alanine olefin amino acid connected by an all-carbon crosslinker comprising one double bond
  misc_feature (11)..(13): Crosslink between residues
  MOD_RES (13)..(13): Alpha-Me S5-pentenyl-alanine olefin amino acid connected by an all-carbon crosslinker comprising one double bond
  MOD_RES (14)..(14): Norleucine
  C-term NH2
LTFAAYWAALASAL

SEQ ID NO: 13 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(9): Crosslink between residues
  MOD_RES (9)..(9): Alpha-Me S5-pentenyl-alanine olefin amino acid connected by an all-carbon crosslinker comprising one double bond
  MOD_RES (11)..(11): Alpha-Me S5-pentenyl-alanine olefin amino acid connected by an all-carbon crosslinker comprising one double bond
  misc_feature (11)..(13): Crosslink between residues
  MOD_RES (13)..(13): Alpha-Me S5-pentenyl-alanine olefin amino acid connected by an all-carbon crosslinker comprising one double bond
  C-term NH2
LTFAAYWAALASAA

SEQ ID NO: 14 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (12)..(12): Norleucine
  C-term NH2
FAAYWEXLAAAL

SEQ ID NO: 15 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAAL

SEQ ID NO: 16 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAAM

SEQ ID NO: 17 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (12)..(12): hLeu
  C-term NH2
FAAYWEXLAAAL

SEQ ID NO: 18 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAAF

SEQ ID NO: 19 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAAI

SEQ ID NO: 20 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (12)..(12): Cyclohexyl-Gly
  C-term NH2
FAAYWEXLAAAG

SEQ ID NO: 21 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (12)..(12): Cyclohexyl-Ala
  C-term NH2
FAAYWEXLAAAA

SEQ ID NO: 22 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (12)..(12): 2-aminoisobutyric acid
  C-term NH2
FAAYWEXLAAAX

SEQ ID NO: 23 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
LTFAAYWAQLAAAXV

SEQ ID NO: 24 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
LTFAAYWAQLAAAXV

SEQ ID NO: 25 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  C-term NH2
LTFAAYWAQLASXAA

SEQ ID NO: 26 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  C-term NH2
LTFAAYWAQLASXAA

SEQ ID NO: 27 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(16): Norleucine
  C-term NH2
HLTFAHHWHQLAAALL

SEQ ID NO: 28 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
DLTFAHHWHQLARRLV

SEQ ID NO: 29 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
HHTFAHHWHQLAAAML

SEQ ID NO: 30 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Cyclohexyl-Ala
  C-term NH2
FAHHWHQLARRDA

SEQ ID NO: 31 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHHWHQLAHRFV

SEQ ID NO: 32 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): hLeu
  C-term NH2
HLTFAHHWHQLAAALA

SEQ ID NO: 33 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Cyclohexyl-Gly
  MOD_RES (16)..(16): D-amino acid
  C-term NH2
DLTFAHHWHQLARRGL

SEQ ID NO: 34 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Cyclohexyl-Gly
  MOD_RES (16)..(16): D-amino acid
  C-term NH2
DLTFAHHWHQLARRGL

SEQ ID NO: 35 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Cyclohexyl-Ala
  MOD_RES (16)..(16): D-amino acid
  C-term NH2
HHTFAHHWHQLAAAAV

SEQ ID NO: 36 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAHHWHQLARRDA

SEQ ID NO: 37 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): 2-aminoisobutyric acid
  C-term NH2
FAHHWHQLAHRXG

SEQ ID NO: 38 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  C-term NH2
FAAYWAQLAHHLL

SEQ ID NO: 39 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Norleucine
  C-term NH2
FAAYWSALAHQAL

SEQ ID NO: 40 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Cyclohexyl-Gly
  MOD_RES (13)..(13): D-amino acid
  C-term NH2
FAAYWVQLAQHGL

SEQ ID NO: 41 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  MOD_RES (13)..(13): D-amino acid
  C-term NH2
FAAYWTALAQQLV

SEQ ID NO: 42 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (11)..(11): 2-aminoisobutyric acid
  MOD_RES (13)..(13): D-amino acid
  C-term NH2
FAAYWYQLAHXAA

SEQ ID NO: 43 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAHHLA

SEQ ID NO: 44 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAHHLA

SEQ ID NO: 45 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAHQLV

SEQ ID NO: 46 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAHQLV

SEQ ID NO: 47 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAQQML

SEQ ID NO: 48 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAQQML

SEQ ID NO: 49 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  MOD_RES (14)..(14): hLeu
  C-term NH2
LTFAAYWAQLAHXLV

SEQ ID NO: 50 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAHFA

SEQ ID NO: 51 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  MOD_RES (16)..(16): D-amino acid
  C-term NH2
HLTFAHHWHQLAAALL

SEQ ID NO: 52 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (16)..(16): D-amino acid
  C-term NH2
DLTFAHHWHQLARRLA

SEQ ID NO: 53 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (16)..(16): D-amino acid
  C-term NH2
HHTFAHHWHQLAAAMV

SEQ ID NO: 54 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHHWHQLARRDA

SEQ ID NO: 55 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Cyclohexyl-Ala
  C-term NH2
FAHHWHQLAHRFA

SEQ ID NO: 56 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHAm
FAAYWEALAAA

SEQ ID NO: 57 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHiAm
FAAYWEALAAA

SEQ ID NO: 58 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHnPr3Ph
FAAYWEALAAA

SEQ ID NO: 59 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHnBu33Me
FAAYWEALAAA

SEQ ID NO: 60 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHnPr
FAAYWEALAAA

SEQ ID NO: 61 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHnEt2Ch
FAAYWEALAAA

SEQ ID NO: 62 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHnEt2Cp
FAAYWEALAAA

SEQ ID NO: 63 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHHex
FAAYWEALAAA

SEQ ID NO: 64 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAAIA

SEQ ID NO: 65 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAAIA

SEQ ID NO: 66 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAALAAAMA

SEQ ID NO: 67 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAALAAAMA

SEQ ID NO: 68 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 69 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 70 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAIA

SEQ ID NO: 71 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAIA

SEQ ID NO: 72 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAMA

SEQ ID NO: 73 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAMA

SEQ ID NO: 74 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAAALA

SEQ ID NO: 75 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAAALA

SEQ ID NO: 76 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAIV

SEQ ID NO: 77 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAIV

SEQ ID NO: 78 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAMV

SEQ ID NO: 79 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAALAAALV

SEQ ID NO: 80 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAALAAALV

SEQ ID NO: 81 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAIL

SEQ ID NO: 82 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAIL

SEQ ID NO: 83 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAML

SEQ ID NO: 84 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAAALL

SEQ ID NO: 85 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAAALL

SEQ ID NO: 86 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAAAMA

SEQ ID NO: 87 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  C-term NH2
FAAYWEALAAALA

SEQ ID NO: 88 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAAYWEALAAAIA

SEQ ID NO: 89 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAAYWEALAAAMA

SEQ ID NO: 90 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  MOD_RES (13)..(13): D-amino acid
  C-term NH2
FAAYWEALAAALA

SEQ ID NO: 91 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAAYWEALAAAIV

SEQ ID NO: 92 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAAYWEALAAAMV

SEQ ID NO: 93 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  MOD_RES (13)..(13): D-amino acid
  C-term NH2
FAAYWEALAAALV

SEQ ID NO: 94 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAAYWEALAAAIL

SEQ ID NO: 95 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAAYWEALAAAML

SEQ ID NO: 96 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  MOD_RES (13)..(13): D-amino acid
  C-term NH2
FAAYWEALAAALL

SEQ ID NO: 97 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  MOD_RES (13)..(13): D-amino acid
  C-term NH2
FAAYWEALAAALL

SEQ ID NO: 98 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 99 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 100 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
WTFAFYWSQLAAVAA

SEQ ID NO: 101 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
WTFAFYWSQLAAVAA

SEQ ID NO: 102 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAVYWSQLAAVA

SEQ ID NO: 103 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAVYWSQLAAVA

SEQ ID NO: 104 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
WTFAFYWSQLASAAA

SEQ ID NO: 105 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
WTFAFYWSQLASAAA

SEQ ID NO: 106 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(16): D-amino acid
  C-term NH2
WTFAVYWSQLAAVAAA

SEQ ID NO: 107 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(16): D-amino acid
  C-term NH2
WTFAVYWSQLAAVAAA

SEQ ID NO: 108 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAVG

SEQ ID NO: 109 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAVG

SEQ ID NO: 110 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAVQ

SEQ ID NO: 111 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAVQ

SEQ ID NO: 112 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAAYWAQLASAA

SEQ ID NO: 113 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAAYWAQLASAA

SEQ ID NO: 114 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 115 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 116 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Two pentenyl-alanine olefin side chains, each of which is crosslinked to another amino acid as indicated
  misc_feature (11)..(14): Crosslink between residues
  MOD_RES (14)..(14): Alpha-Me S5-pentenyl-alanine olefin amino acid connected by an all-carbon crosslinker comprising one double bond
  C-term NH2
LTFAAYWEQLASAA

SEQ ID NO: 117 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASLA

SEQ ID NO: 118 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASLA

SEQ ID NO: 119 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASWA

SEQ ID NO: 120 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASWA

SEQ ID NO: 121 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASVS

SEQ ID NO: 122 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASAS

SEQ ID NO: 123 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASVG

SEQ ID NO: 124 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
ETFAVYWAQLASAA

SEQ ID NO: 125 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASAA

SEQ ID NO: 126 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASVA

SEQ ID NO: 127 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASLA

SEQ ID NO: 128 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASWA

SEQ ID NO: 129 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAKYWAQLASWA

SEQ ID NO: 130 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASVS

SEQ ID NO: 131 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASAS

SEQ ID NO: 132 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASVG

SEQ ID NO: 133 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAVYWAQLASSA

SEQ ID NO: 134 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
ETFAVYWAQLASSA

SEQ ID NO: 135 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAVYWAQLASNA

SEQ ID NO: 136 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
ETFAVYWAQLASNA

SEQ ID NO: 137 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAVYWAQLASAA

SEQ ID NO: 138 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASVA

SEQ ID NO: 139 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASVA

SEQ ID NO: 140 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASWA

SEQ ID NO: 141 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASVS

SEQ ID NO: 142 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASVS

SEQ ID NO: 143 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASAS

SEQ ID NO: 144 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASAS

SEQ ID NO: 145 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASVG

SEQ ID NO: 146 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASVG

SEQ ID NO: 147 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 148 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 149 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclopentyl-Gly
  MOD_RES (11)..(11): Alpha-Me S5-pentenyl-alanine olefin amino acid connected by an all-carbon crosslinker comprising one double bond
  C-term NH2
LTFAEYWAQGASAA

SEQ ID NO: 150 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclopentyl-Gly
  MOD_RES (11)..(11): Alpha-Me S5-pentenyl-alanine olefin amino acid connected by an all-carbon crosslinker comprising one double bond
  C-term NH2
LTFAEYWAQGASAA

SEQ ID NO: 151 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQFASAA

SEQ ID NO: 152 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQFASAA

SEQ ID NO: 153 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 154 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 155 - protein, 14 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 156 - protein, 14 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 157 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 158 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 159 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 160 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 161 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEYWAQLASAA

SEQ ID NO: 162 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWVQLASAA

SEQ ID NO: 163 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAHWAQLASAA

SEQ ID NO: 164 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAEWAQLASAA

SEQ ID NO: 165 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAASWAQLASAA

SEQ ID NO: 166 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAEWAQLASAA

SEQ ID NO: 167 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAASWAQLASAA

SEQ ID NO: 168 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (11)..(11): Alpha-Me S5-pentenyl-alanine olefin amino acid connected by an all-carbon crosslinker comprising one double bond
  C-term NH2
LTFAAFWAQLASAA

SEQ ID NO: 169 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (11)..(11): Alpha-Me S5-pentenyl-alanine olefin amino acid connected by an all-carbon crosslinker comprising one double bond
  C-term NH2
LTFAAFWAQLASAA

SEQ ID NO: 170 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAHWAQLAAAIA

SEQ ID NO: 171 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ITFAFYWAQLAAAIA

SEQ ID NO: 172 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ITFAEHWAQLAAAIA

SEQ ID NO: 173 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ITFAEHWAQLAAAIA

SEQ ID NO: 174 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ETFAEHWAQLAAAIA

SEQ ID NO: 175 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ETFAEHWAQLAAAIA

SEQ ID NO: 176 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAHWVQLAAAIA

SEQ ID NO: 177 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ITFAFYWVQLAAAIA

SEQ ID NO: 178 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ITFAEYWVQLAAAIA

SEQ ID NO: 179 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ITFAEHWVQLAAAIA

SEQ ID NO: 180 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAEWAQLAAAIA

SEQ ID NO: 181 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAFWAQLAAAIA

SEQ ID NO: 182 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAFWAQLAAAIA

SEQ ID NO: 183 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAHWAQLAAHFA

SEQ ID NO: 184 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFYWAQLAAHFA

SEQ ID NO: 185 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFYWAQLAAHFA

SEQ ID NO: 186 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFHWAQLAAEFA

SEQ ID NO: 187 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFHWAQLAAEFA

SEQ ID NO: 188 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWAQLAAHFA

SEQ ID NO: 189 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWAQLAAHFA

SEQ ID NO: 190 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAHWVQLAAHFA

SEQ ID NO: 191 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFYWVQLAAHFA

SEQ ID NO: 192 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEYWVQLAAHFA

SEQ ID NO: 193 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWVQLAAHFA

SEQ ID NO: 194 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWVQLAAHFA

SEQ ID NO: 195 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEYWAALASAA

SEQ ID NO: 196 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWVALASAA

SEQ ID NO: 197 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAHWAALASAA

SEQ ID NO: 198 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAEWAALASAA

SEQ ID NO: 199 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAEWAALASAA

SEQ ID NO: 200 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAASWAALASAA

SEQ ID NO: 201 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAASWAALASAA

SEQ ID NO: 202 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAIA

SEQ ID NO: 203 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAIA

SEQ ID NO: 204 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAALAAHFA

SEQ ID NO: 205 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAHIA

SEQ ID NO: 206 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAHIA

SEQ ID NO: 207 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAHWAQLAAHIA

SEQ ID NO: 208 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAHIA

SEQ ID NO: 209 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAFA

SEQ ID NO: 210 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAFA

SEQ ID NO: 211 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAWA

SEQ ID NO: 212 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAVA

SEQ ID NO: 213 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAVA

SEQ ID NO: 214 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAALA

SEQ ID NO: 215 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAALA

SEQ ID NO: 216 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAIA

SEQ ID NO: 217 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAIA

SEQ ID NO: 218 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAFA

SEQ ID NO: 219 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAFA

SEQ ID NO: 220 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAVA

SEQ ID NO: 221 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAVA

SEQ ID NO: 222 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAAIA

SEQ ID NO: 223 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAAIA

SEQ ID NO: 224 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAAWA

SEQ ID NO: 225 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAAWA

SEQ ID NO: 226 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAALA

SEQ ID NO: 227 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAALA

SEQ ID NO: 228 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ETFAEHWVQLAAALA

SEQ ID NO: 229 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAAA

SEQ ID NO: 230 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAAA

SEQ ID NO: 231 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
LTFAAYWAQLAAAXA

SEQ ID NO: 232 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
LTFAAYWAQLAAAXA

SEQ ID NO: 233 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): D-amino acid
  C-term NH2
LTFAAYWAQLAAAAAA

SEQ ID NO: 234 - protein, 15 aa, Artificial Sequence
  Description of Artificial Sequence: Synthetic peptide
  N-term Ac
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (11)..(11): Alpha-Me S8-octenyl-alanine olefin amino acid connected by an all-carbon crosslinker comprising one double bond
  MOD_RES (15)..(15): D-amino acid
  C-term NH2
LTFAAYWAQLAAAIA

SEQ ID NO: 235 - protein, 14 aa, Artificial Sequence
  Description of Artificial Sequence: Synthetic peptide
  N-term Ac
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (11)..(11): Alpha-Me S8-octenyl-alanine olefin amino acid connected by an all-carbon crosslinker comprising one double bond
  C-term NH2
LTFAAYWAQLASAA

SEQ ID NO: 236 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQAAAALA

SEQ ID NO: 237 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
ETFAAYWAQAAAALA

SEQ ID NO: 238 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQAAAALA

SEQ ID NO: 239 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQAAAWLA

SEQ ID NO: 240 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
ETFAAYWAQAAAWLA

SEQ ID NO: 241 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQAAAWLA

SEQ ID NO: 242 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAFA

SEQ ID NO: 243 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQAASALA

SEQ ID NO: 244 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEFWAQAASALA

SEQ ID NO: 245 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWSQAASALA

SEQ ID NO: 246 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWWQAASALA

SEQ ID NO: 247 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAAAAIA

SEQ ID NO: 248 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAAAAIA

SEQ ID NO: 249 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEFWAQAAAAIA

SEQ ID NO: 250 - protein, 14 aa, Artificial Sequence
  Description of Artificial Sequence: Synthetic peptide
  N-term Pam
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
ETFAEYWAQAASAA

SEQ ID NO: 251 - protein, 14 aa, Artificial Sequence
  Description of Artificial Sequence: Synthetic peptide
  N-term Ac
  MOD_RES (3)..(3): homo-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEFWAQAASAA

SEQ ID NO: 252 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTAAEYWAQAASAA

SEQ ID NO: 253 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYAAQAASAA

SEQ ID NO: 254 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 2-Naphthalanine
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYAAQAASAA

SEQ ID NO: 255 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAASAA

SEQ ID NO: 256 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAF

SEQ ID NO: 257 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAASAFA

SEQ ID NO: 258 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAASAF

SEQ ID NO: 259 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAASAF

SEQ ID NO: 260 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAFWAQAASAF

SEQ ID NO: 261 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAF

SEQ ID NO: 262 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWSQAASAF

SEQ ID NO: 263 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWWQAASAF

SEQ ID NO: 264 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQAAAAIA

SEQ ID NO: 265 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQAAAAIA

SEQ ID NO: 266 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQAAAAIA

SEQ ID NO: 267 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAFWAQAAAAIA

SEQ ID NO: 268 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAAAAFA

SEQ ID NO: 269 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAAAAFA

SEQ ID NO: 270 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
ETFAAYWAQAAAWLA

SEQ ID NO: 271 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAEYWAQAAAWLA

SEQ ID NO: 272 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
ETFAEYWAQAAAWLA

SEQ ID NO: 273 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
ETFAEYWAQAAAWLA

SEQ ID NO: 274 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQAASAFA

SEQ ID NO: 275 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQAASAFA

SEQ ID NO: 276 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
ETFAAYWAQLAAWLA

SEQ ID NO: 277 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAEYWAQLAAWLA

SEQ ID NO: 278 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
ETFAEYWAQLAAWLA

SEQ ID NO: 279 - protein, 14 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 280 - protein, 14 aa, Artificial Sequence
  Description of Artificial Sequence: Synthetic peptide
  N-term Hexac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 281 - protein, 14 aa, Artificial Sequence
  Description of Artificial Sequence: Synthetic peptide
  N-term Napac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 282 - protein, 14 aa, Artificial Sequence
  Description of Artificial Sequence: Synthetic peptide
  N-term Decac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 283 - protein, 14 aa, Artificial Sequence
  Description of Artificial Sequence: Synthetic peptide
  N-term Admac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 284 - protein, 14 aa, Artificial Sequence
  Description of Artificial Sequence: Synthetic peptide
  N-term Tmac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 285 - protein, 14 aa, Artificial Sequence
  Description of Artificial Sequence: Synthetic peptide
  N-term Pam
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 286 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQAAAALA

SEQ ID NO: 287 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAAAAIA

SEQ ID NO: 288 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 289 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 290 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEFWAQAASAA

SEQ ID NO: 291 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEFWAQAASAA

SEQ ID NO: 292 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWSQAASAA

SEQ ID NO: 293 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWSQAASAA

SEQ ID NO: 294 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 295 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLASAF

SEQ ID NO: 296 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLASAF

SEQ ID NO: 297 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 298 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 299 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAFWAQLASAA

SEQ ID NO: 300 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAFWAQLASAA

SEQ ID NO: 301 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWSQLASAA

SEQ ID NO: 302 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWSQLASAA

SEQ ID NO: 303 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQLAAALA

SEQ ID NO: 304 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 305 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAFWAQLAAALA

SEQ ID NO: 306 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWSQLAAALA

SEQ ID NO: 307 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 308 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 309 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAFWAQLAAALA

SEQ ID NO: 310 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAFWAQLAAALA

SEQ ID NO: 311 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWSQLAAALA

SEQ ID NO: 312 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWSQLAAALA

SEQ ID NO: 313 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (16)..(16): D-amino acid
  C-term NH2
LTFAAYWAQLAAAAAA

SEQ ID NO: 314 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (16)..(16): D-amino acid
  C-term NH2
LTFAAYWAQLAAAAAA

SEQ ID NO: 315 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAAAAAAA

SEQ ID NO: 316 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (18)..(18): D-amino acid
  C-term NH2
LTFAAYWAQLAAAAAAAA

SEQ ID NO: 317 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (18)..(18): D-amino acid
  C-term NH2
LTFAAYWAQLAAAAAAAA

SEQ ID NO: 318 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQLAAALA

SEQ ID NO: 319 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
AATFAAYWAQLAAALA

SEQ ID NO: 320 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALAA

SEQ ID NO: 321 - protein, 17 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
ALTFAAYWAQLAAALAA

SEQ ID NO: 322 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQAAAALAA

SEQ ID NO: 323 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALAA

SEQ ID NO: 324 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAAA

SEQ ID NO: 325 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAAA

SEQ ID NO: 326 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAAAA

SEQ ID NO: 327 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAAAA

SEQ ID NO: 328 - protein, 15 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 329 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAAA

SEQ ID NO: 330 - protein, 15 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 331 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 332 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 333 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEFWAQAASALA

SEQ ID NO: 334 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEFWAQAASALA

SEQ ID NO: 335 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEFWAQAAAAIA

SEQ ID NO: 336 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEFWAQAAAAIA

SEQ ID NO: 337 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAAAAAAA

SEQ ID NO: 338 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAAAAAAA

SEQ ID NO: 339 - protein, 16 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(4): Crosslink between residues
  MOD_RES (5)..(5): 6cl-Trp
  MOD_RES (16)..(16): D-amino acid
  C-term NH2
FAAYWEALAAAAAAAA

SEQ ID NO: 340 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
ETFAEYWAQLAAAAAAA

SEQ ID NO: 341 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
ETFAEYWAQLAAAAAAA

SEQ ID NO: 342 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (18)..(18): D-amino acid
  C-term NH2
LTFAEYWAQLAAAAAAAA

SEQ ID NO: 343 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (18)..(18): D-amino acid
  C-term NH2
LTFAEYWAQLAAAAAAAA

SEQ ID NO: 344 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (17)..(17): D-amino acid
  C-term NH2
LTFAAYWAQLAAALAAA

SEQ ID NO: 345 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (17)..(17): D-amino acid
  C-term NH2
LTFAAYWAQLAAALAAA

SEQ ID NO: 346 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQAAAAAAAA

SEQ ID NO: 347 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQAAAAAAAA

SEQ ID NO: 348 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEFWAQAAAAAAAA

SEQ ID NO: 349 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEFWAQAAAAAAAA

SEQ ID NO: 350 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWSQAAAAAAAA

SEQ ID NO: 351 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWSQAAAAAAAA

SEQ ID NO: 352 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAASAAA

SEQ ID NO: 353 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAASAAA

SEQ ID NO: 354 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  MOD_RES (16)..(16): D-amino acid
  C-term NH2
ALTFAEYWAQAASAAA

SEQ ID NO: 355 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  MOD_RES (16)..(16): D-amino acid
  C-term NH2
ALTFAEYWAQAASAAA

SEQ ID NO: 356 - protein, 17 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  MOD_RES (17)..(17): D-amino acid
  C-term NH2
ALTFAEYWAQAASAAAA

SEQ ID NO: 357 - protein, 17 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  MOD_RES (17)..(17): D-amino acid
  C-term NH2
ALTFAEYWAQAASAAAA

SEQ ID NO: 358 - protein, 18 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (12)..(12): Cyclobutyl-Ala
  MOD_RES (13)..(13): Alpha-Me S5-pentenyl-alanine olefin amino acid connected by an all-carbon crosslinker comprising one double bond
  MOD_RES (18)..(18): D-amino acid
  C-term NH2
AALTFAEYWAQAASAAAA

SEQ ID NO: 359 - protein, 18 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (12)..(12): Cyclobutyl-Ala
  MOD_RES (13)..(13): Alpha-Me S5-pentenyl-alanine olefin amino acid connected by an all-carbon crosslinker comprising one double bond
  MOD_RES (18)..(18): D-amino acid
  C-term NH2
AALTFAEYWAQAASAAAA

SEQ ID NO: 360 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
RTFAEYWAQAASAA

SEQ ID NO: 361 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LRFAEYWAQAASAA

SEQ ID NO: 362 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWRQAASAA

SEQ ID NO: 363 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWARAASAA

SEQ ID NO: 364 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAARAA

SEQ ID NO: 365 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASRA

SEQ ID NO: 366 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAR

SEQ ID NO: 367 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 368 - protein, 16 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
ALTFAAYWAQLAAALA

SEQ ID NO: 369 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LAFAEYWAQLAAALA

SEQ ID NO: 370 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
ATFAEYWAQLAAALA

SEQ ID NO: 371 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
AAFAEYWAQLAAALA

SEQ ID NO: 372 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
AAAFAEYWAQLAAALA

SEQ ID NO: 373 - protein, 17 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): Norleucine
  C-term NH2
AAAAFAEYWAQLAAALA

SEQ ID NO: 374 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
AATFAEYWAQLAAALA

SEQ ID NO: 375 - protein, 17 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): Norleucine
  C-term NH2
AALTFAEYWAQLAAALA

SEQ ID NO: 376 - protein, 18 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  MOD_RES (17)..(17): Norleucine
  C-term NH2
AAALTFAEYWAQLAAALA

SEQ ID NO: 377 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQLAAALAA

SEQ ID NO: 378 - protein, 17 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
ALTFAEYWAQLAAALAA

SEQ ID NO: 379 - protein, 18 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): Norleucine
  C-term NH2
AALTFAEYWAQLAAALAA

SEQ ID NO: 380 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQAAAALAA

SEQ ID NO: 381 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQLAAALAA

SEQ ID NO: 382 - protein, 17 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): hLeu
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
ALTFAEYWAQLAAALAA

SEQ ID NO: 383 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): N-methyl-Tyr
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 384 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): N-methyl-Tyr
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 385 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): N-methyl-Trp
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 386 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): N-methyl-Trp
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 387 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): Alpha-Me-Trp
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 388 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): Alpha-Me-Trp
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 389 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): 2-aminoisobutyric acid
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWXQLAAALA

SEQ ID NO: 390 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): 2-aminoisobutyric acid
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWXQLAAALA

SEQ ID NO: 391 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  MOD_RES (14)..(14): Norleucine
  C-term NH2
LTFAAYWAQLAAXLA

SEQ ID NO: 392 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  MOD_RES (14)..(14): Norleucine
  C-term NH2
LTFAAYWAQLAAXLA

SEQ ID NO: 393 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): D-amino acid
  MOD_RES (14)..(14): Norleucine
  C-term NH2
LTFAAYWAQLAAALA

SEQ ID NO: 394 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): D-amino acid
  MOD_RES (14)..(14): Norleucine
  C-term NH2
LTFAAYWAQLAAALA

SEQ ID NO: 395 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): Sarcosine
  MOD_RES (14)..(14): Norleucine
  C-term NH2
LTFAAYWAQLAAXLA

SEQ ID NO: 396 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): Sarcosine
  MOD_RES (14)..(14): Norleucine
  C-term NH2
LTFAAYWAQLAAXLA

SEQ ID NO: 397 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): 2-aminoisobutyric acid
  C-term NH2
LTFAAYWAQLAAALX

SEQ ID NO: 398 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): 2-aminoisobutyric acid
  C-term NH2
LTFAAYWAQLAAALX

SEQ ID NO: 399 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): N-methyl-Ala
  C-term NH2
LTFAAYWAQLAAALA

SEQ ID NO: 400 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): N-methyl-Ala
  C-term NH2
LTFAAYWAQLAAALA

SEQ ID NO: 401 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): Sarcosine
  C-term NH2
LTFAAYWAQLAAALX

SEQ ID NO: 402 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): Sarcosine
  C-term NH2
LTFAAYWAQLAAALX

SEQ ID NO: 403 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): 2-aminoisobutyric acid
  C-term NH2
LTFAAYWAQLAAALAX

SEQ ID NO: 404 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): 2-aminoisobutyric acid
  C-term NH2
LTFAAYWAQLAAALAX

SEQ ID NO: 405 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): N-methyl-Ala
  C-term NH2
LTFAAYWAQLAAALAA

SEQ ID NO: 406 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): N-methyl-Ala
  C-term NH2
LTFAAYWAQLAAALAA

SEQ ID NO: 407 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): D-amino acid
  C-term NH2
LTFAAYWAQLAAALAA

SEQ ID NO: 408 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): D-amino acid
  C-term NH2
LTFAAYWAQLAAALAA

SEQ ID NO: 409 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): Sarcosine
  C-term NH2
LTFAAYWAQLAAALAX

SEQ ID NO: 410 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): Sarcosine
  C-term NH2
LTFAAYWAQLAAALAX

SEQ ID NO: 411 - protein, 15 aa, Artificial Sequence
  Description of Artificial Sequence: Synthetic peptide
  N-term Ac
  MOD_RES (4)..(4): Alpha-Me R8-octenyl-alanine olefin amino acid that is not connected by a crosslinker
  MOD_RES (11)..(11): Alpha-Me S5-pentenyl-alanine olefin amino acid that is not connected by a crosslinker
  MOD_RES (14)..(14): Norleucine
  C-term NH2
LTFAAYWAQLAAALA

SEQ ID NO: 412 - protein, 15 aa, Artificial Sequence
  Description of Artificial Sequence: Synthetic peptide
  N-term Ac
  MOD_RES (4)..(4): 2-aminoisobutyric acid
  MOD_RES (11)..(11): 2-aminoisobutyric acid
  MOD_RES (14)..(14): Norleucine
  C-term NH2
LTFXAYWAQLXAALA

SEQ ID NO: 413 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Cou4
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAXYWAQLAAALA

SEQ ID NO: 414 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Cou4
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAXYWAQLAAALA

SEQ ID NO: 415 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou4
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWXQLAAALA

SEQ ID NO: 416 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): Cou4
  MOD_RES (14)..(14): Norleucine
  C-term NH2
LTFAAYWAQLAXALA

SEQ ID NO: 417 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): Cou4
  MOD_RES (14)..(14): Norleucine
  C-term NH2
LTFAAYWAQLAXALA

SEQ ID NO: 418 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): Cou4
  MOD_RES (14)..(14): Norleucine
  C-term NH2
LTFAAYWAQLAAXLA

SEQ ID NO: 419 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): Cou4
  MOD_RES (14)..(14): Norleucine
  C-term NH2
LTFAAYWAQLAAXLA

SEQ ID NO: 420 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term OH
LTFAAYWAQLAAALA

SEQ ID NO: 421 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term OH
LTFAAYWAQLAAALA

SEQ ID NO: 422 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NHnPr
LTFAAYWAQLAAALA

SEQ ID NO: 423 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NHnPr
LTFAAYWAQLAAALA

SEQ ID NO: 424 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NHnBu33Me
LTFAAYWAQLAAALA

SEQ ID NO: 425 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NHnBu33Me
LTFAAYWAQLAAALA

SEQ ID NO: 426 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NHHex
LTFAAYWAQLAAALA

SEQ ID NO: 427 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NHHex
LTFAAYWAQLAAALA

SEQ ID NO: 428 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTAAAYWAQLAAALA

SEQ ID NO: 429 - protein, 15 aa, Artificial Sequence
  Description of Artificial Sequence: Synthetic peptide
  N-term Ac
  MOD_RES (3)..(3): hLeu
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTLAAYWAQLAAALA

SEQ ID NO: 430 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYAAQLAAALA

SEQ ID NO: 431 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 2-Naphthalanine
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYAAQLAAALA

SEQ ID NO: 432 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou4
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWXQAASAA

SEQ ID NO: 433 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWXQAASAA

SEQ ID NO: 434 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon saturated crosslinker comprising no double bonds
  C-term NH2
LTFAEYWAQAASAA

SEQ ID NO: 435 - protein, 14 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 436 - protein, 17 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAAAAAAA

SEQ ID NO: 437 - protein, 17 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAAAAAAA

SEQ ID NO: 438 - protein, 17 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 439 - protein, 17 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 440 - protein, 15 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEFWAQAAAAIA

SEQ ID NO: 441 - protein, 15 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEFWAQAAAAIA

SEQ ID NO: 442 - protein, 15 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 443 - protein, 15 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 444 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  MOD_RES (14)..(14): Norleucine
  C-term NH2
LTFAAYWAQLAAALA

SEQ ID NO: 445 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  MOD_RES (17)..(17): D-amino acid
  C-term NH2
LTFAEYWAQLAAAAAAA

SEQ ID NO: 446 - protein, 16 aa, Artificial Sequence
  Description of Artificial Sequence: Synthetic peptide
  MOD_RES (1)..(1): Cou6
  MOD_RES (2)..(2): Beta-Ala
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (12)..(12): hLeu
  MOD_RES (13)..(13): Alpha-Me S5-pentenyl-alanine olefin amino acid connected by an all-carbon crosslinker comprising one double bond
  C-term NH2
XALTFAEYWAQLASAA

SEQ ID NO: 447 - protein, 16 aa, Artificial Sequence
  Description of Artificial Sequence: Synthetic peptide
  MOD_RES (1)..(1): Cou8
  MOD_RES (2)..(2): Beta-Ala
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (12)..(12): hLeu
  MOD_RES (13)..(13): Alpha-Me S5-pentenyl-alanine olefin amino acid connected by an all-carbon crosslinker comprising one double bond
  C-term NH2
XALTFAEYWAQLASAA

SEQ ID NO: 448 - protein, 17 aa, Artificial Sequence
  Description of Artificial Sequence: Synthetic peptide
  N-term Ac
  MOD_RES (3)..(3): 4-iodo-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 449 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 450 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term OH
LTFAEYWAQLAAAAAAA

SEQ ID NO: 451 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term OH
LTFAEYWAQLAAAAAAA

SEQ ID NO: 452 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAELAAAAAAA

SEQ ID NO: 453 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAELAAAAAAA

SEQ ID NO: 454 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term OH
LTFAEYWAELAAAAAAA

SEQ ID NO: 455 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 456 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4bOH2
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEFWAQLAAAAAAA

SEQ ID NO: 457 - protein, 20 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  MOD_RES (20)..(20): D-amino acid
  C-term NH2
AAALTFAEYWAQLAAAAAAA

SEQ ID NO: 458 - protein, 17 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 459 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
RTFAEYWAQLAAAAAAA

SEQ ID NO: 460 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTAAEYWAQLAAAAAAA

SEQ ID NO: 461 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): 2-aminoisobutyric acid
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWXQLAAAAAAA

SEQ ID NO: 462 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  MOD_RES (17)..(17): D-amino acid
  C-term NH2
LTFAEYWAQLAAXAAAA

SEQ ID NO: 463 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  MOD_RES (17)..(17): D-amino acid
  C-term NH2
LTFAEYWAQLAAAXAAA

SEQ ID NO: 464 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): 2-aminoisobutyric acid
  MOD_RES (17)..(17): D-amino acid
  C-term NH2
LTFAEYWAQLAAAAXAA

SEQ ID NO: 465 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): 2-aminoisobutyric acid
  MOD_RES (17)..(17): D-amino acid
  C-term NH2
LTFAEYWAQLAAAAAXA

SEQ ID NO: 466 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): 2-aminoisobutyric acid
  MOD_RES (17)..(17): D-amino acid
  C-term NH2
LTFAEYWAQLAAAAAXA

SEQ ID NO: 467 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): 2-aminoisobutyric acid
  C-term NH2
LTFAEYWAQLAAAAAAX

SEQ ID NO: 468 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): D-amino acid
  MOD_RES (17)..(17): D-amino acid
  C-term NH2
LTFAEYWAQLAAAAAAA

SEQ ID NO: 469 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  MOD_RES (17)..(17): D-amino acid
  C-term NH2
LTFAEYWAQLAAAAAAA

SEQ ID NO: 470 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  MOD_RES (17)..(17): D-amino acid
  C-term NH2
LTFAEYWAQLAAAAAAA

SEQ ID NO: 471 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  MOD_RES (17)..(17): D-amino acid
  C-term NH2
LTFAEYWAQLAAAAAAA

SEQ ID NO: 472 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(17): D-amino acid
  C-term NH2
LTFAEYWAQLAAAAAAA

SEQ ID NO: 473 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAAAAAAA

SEQ ID NO: 474 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): Sarcosine
  MOD_RES (17)..(17): D-amino acid
  C-term NH2
LTFAEYWAQLAAXAAAA

SEQ ID NO: 475 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Sarcosine
  MOD_RES (17)..(17): D-amino acid
  C-term NH2
LTFAEYWAQLAAAXAAA

SEQ ID NO: 476 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): Sarcosine
  MOD_RES (17)..(17): D-amino acid
  C-term NH2
LTFAEYWAQLAAAAXAA

SEQ ID NO: 477 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): Sarcosine
  MOD_RES (17)..(17): D-amino acid
  C-term NH2
LTFAEYWAQLAAAAAXA

SEQ ID NO: 478 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): Sarcosine
  C-term NH2
LTFAEYWAQLAAAAAAX

SEQ ID NO: 479 - protein, 17 aa, Artificial Sequence
  Description of Artificial Sequence: Synthetic peptide
  N-term Ac
  MOD_RES (1)..(1): N15 isotopic-Leu
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 480 - protein, 16 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  MOD_RES (16)..(16): D-amino acid
  C-term NH2
TFAEYWAQLAAAAAAA

SEQ ID NO: 481 - protein, 15 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (15)..(15): D-amino acid
  C-term NH2
FAEYWAQLAAAAAAA

SEQ ID NO: 482 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LVFAEYWAQLAAAAAAA

SEQ ID NO: 483 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
AAFAEYWAQLAAAAAAA

SEQ ID NO: 484 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): D-amino acid
  C-term NH2
LTFAEYWAQLAAAAAA

SEQ ID NO: 485 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAAA

SEQ ID NO: 486 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAEYWAQLAAAA

SEQ ID NO: 487 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): D-amino acid
  C-term NH2
LTFAEYWAQLAAA

SEQ ID NO: 488 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): D-amino acid
  C-term NH2
LTFAEYWAQLAA

SEQ ID NO: 489 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term OH
LTFAEYWAQLAAAA

SEQ ID NO: 490 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term OH
LTFAEYWAQLAA

SEQ ID NO: 491 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAAAA

SEQ ID NO: 492 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term OH
LTFAEYWAQAASAA

SEQ ID NO: 493 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term OH
LTFAEYWAQAAS

SEQ ID NO: 494 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAAS

SEQ ID NO: 495 - protein, 17 aa, Artificial Sequence
  Description of Artificial Sequence: Synthetic peptide
  N-term 4FBzl
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 496 - protein, 14 aa, Artificial Sequence
  Description of Artificial Sequence: Synthetic peptide
  N-term 4FBzl
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 497 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFARYWAQLAAAAAAA

SEQ ID NO: 498 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAHYWAQLAAAAAAA

SEQ ID NO: 499 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAQYWAQLAAAAAAA

SEQ ID NO: 500 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Cit
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAXYWAQLAAAAAAA

SEQ ID NO: 501 - protein, 19 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(13): Crosslink between residues
  MOD_RES (6)..(7): D-amino acid
  MOD_RES (13)..(13): Alpha-Me S5-pentenyl-alanine olefin amino acid connected by an all-carbon crosslinker comprising one double bond
  MOD_RES (19)..(19): D-amino acid
  C-term NH2
LTFAELAYWAQLAAAAAAA

SEQ ID NO: 502 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(12): Crosslink between residues
  MOD_RES (5)..(5): Phe-4
  MOD_RES (6)..(6): D-amino acid
  MOD_RES (12)..(121): Alpha-Me S5-pentenyl-alanine olefin amino acid connected by an all-carbon crosslinker comprising one double bond
  MOD_RES (18)..(18): D-amino acid
  C-term NH2
LTFAFGYWAQLAAAAAAA

SEQ ID NO: 503 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): 2m-Arg
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFARYWAQLAAAAAAA

SEQ ID NO: 504 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): ip-Lys
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAKYWAQLAAAAAAA

SEQ ID NO: 505 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Phe-4NH2
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAFYWAQLAAAAAAA

SEQ ID NO: 506 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAALAAAAAAA

SEQ ID NO: 507 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWALLAAAAAAA

SEQ ID NO: 508 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): 2-aminoisobutyric acid
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAXLAAAAAAA

SEQ ID NO: 509 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWASLAAAAAAA

SEQ ID NO: 510 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWANLAAAAAAA

SEQ ID NO: 511 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Cit
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAXLAAAAAAA

SEQ ID NO: 512 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAHLAAAAAAA

SEQ ID NO: 513 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWARLAAAAAAA

SEQ ID NO: 514 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  MOD_RES (6)..(6): pTyr
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 515 - protein, 14 aa, Artificial Sequence
  Description of Artificial Sequence: Synthetic peptide
  N-term Cbm
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 516 - protein, 17 aa, Artificial Sequence
  Description of Artificial Sequence: Synthetic peptide
  N-term Cbm
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 517 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLASAAAAA

SEQ ID NO: 518 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAASA

SEQ ID NO: 519 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLASAAASA

SEQ ID NO: 520 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(12): Crosslink between residues
  MOD_RES (11)..(11): Beta-Ala
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
LTFAEYWAQTAAAAAAAA

SEQ ID NO: 521 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Adamantyl-Gly
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQGAAAAAAA

SEQ ID NO: 522 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQAAAAAAAA

SEQ ID NO: 523 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): homo-cyclohexyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQAAAAAAAA

SEQ ID NO: 524 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQFAAAAAAA

SEQ ID NO: 525 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): homo-Phe
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQFAAAAAAA

SEQ ID NO: 526 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (17)..(17): D-amino acid
  C-term NH2
LTFAEYWAQLAAALAAA

SEQ ID NO: 527 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Adamantyl-Gly
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (17)..(17): D-amino acid
  C-term NH2
LTFAEYWAQGAAALAAA

SEQ ID NO: 528 - protein, 18 aa, Artificial Sequence
  Description of Artificial Sequence: Synthetic peptide
  N-term 4FBz
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAQLAAAAAAA

SEQ ID NO: 529 - protein, 15 aa, Artificial Sequence
  Description of Artificial Sequence: Synthetic peptide
  N-term 4FBz
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 530 - protein, 17 aa, Artificial Sequence
  Description of Artificial Sequence: Synthetic peptide
  N-term Ac
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (11)..(11): Alpha-Me S8-octenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 531 - protein, 14 aa, Artificial Sequence
  Description of Artificial Sequence: Synthetic peptide
  N-term Ac
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S8-octenyl-alanine olefin amino acid connected by an all-carbon crosslinker comprising one double bond
  C-term NH2
LTFAEYWAQAASAA

SEQ ID NO: 532 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): hhLeu
  MOD_RES (17)..(17): D-amino acid
  C-term NH2
LTFAEYWAQLAAALAAA

SEQ ID NO: 533 - protein, 19 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (19)..(19): D-amino acid
  C-term NH2
LTFAEYWAQLAAAAAAAAA

SEQ ID NO: 534 - protein, 20 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (20)..(20): D-amino acid
  C-term NH2
LTFAEYWAQLAAAAAAAAAA

SEQ ID NO: 535 - protein, 21 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (21)..(21): D-amino acid
  C-term NH2
LTFAEYWAQLAAAAAAAAAAA

SEQ ID NO: 536 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTAAEYAAQAASAA

SEQ ID NO: 537 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTAAEYAAQLAAAAAAA

SEQ ID NO: 538 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Pmp
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEXWAQLAAAAAAA

SEQ ID NO: 539 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Pmp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEXWAQAASAA

SEQ ID NO: 540 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ATFAHYWAQLAS

SEQ ID NO: 541 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHAWAQLAS

SEQ ID NO: 542 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 543 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASA

SEQ ID NO: 544 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 545 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAHYWAQAASAA

SEQ ID NO: 546 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFASYWAQAASAA

SEQ ID NO: 547 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFARYWAQAASAA

SEQ ID NO: 548 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAKYWAQAASAA

SEQ ID NO: 549 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAQYWAQAASAA

SEQ ID NO: 550 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAAAASAA

SEQ ID NO: 551 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAAAAA

SEQ ID NO: 552 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term OH
LTFAEYWAQLAAAAAA

SEQ ID NO: 553 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term OH
LTFAEYWAQLAAAAA

SEQ ID NO: 554 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term OH
LTFAEYWAQLAAA

SEQ ID NO: 555 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4bOH2
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAFWAQLAAAAAAA

SEQ ID NO: 556 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4bOH2
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAFWAALAAAAAAA

SEQ ID NO: 557 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4bOH2
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEFWAQAASAA

SEQ ID NO: 558 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): pY
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAAAAAAA

SEQ ID NO: 559 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): pY
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAALAAAAAAA

SEQ ID NO: 560 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): pY
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 561 - protein, 17 aa, Artificial Sequence
  Description of Artificial Sequence: Synthetic peptide
  N-term Ac
  MOD_RES (4)..(4): Alpha-Me R6-hexynyl-alanine alkynyl amino acids, crosslink via a dialkyne bond with a second alkynyl amino acid
  misc_feature (4)..(11): Crosslink between residues
  MOD_RES (11)..(11): Alpha-Me S5-pentynyl-alanine alkynyl amino acids, wherein the alkyne forms one half of a dialkyne bond with a second alkynyl amino acid
  MOD_RES (17)..(17): D-amino acid
  C-term NH2
LTFAAYWAQLAAAAAAA

SEQ ID NO: 562 - protein, 14 aa, Artificial Sequence
  Description of Artificial Sequence: Synthetic peptide
  N-term Ac
  MOD_RES (4)..(4): Alpha-Me R6-hexynyl-alanine alkynyl amino acids, crosslink via a dialkyne bond with a second alkynyl amino acid
  misc_feature (4)..(11): Crosslink between residues
  MOD_RES (10)..(10): Cyclobutyl-Ala
  MOD_RES (11)..(11): Alpha-Me S5-pentynyl-alanine alkynyl amino acids, wherein the alkyne forms one half of a dialkyne bond with a second alkynyl amino acid
  C-term NH2
LTFAEYWAQAASAA

SEQ ID NO: 563 - protein, 17 aa, Artificial Sequence
  Description of Artificial Sequence: Synthetic peptide
  N-term Ac
  MOD_RES (4)..(4): Alpha-Me R6-hexynyl-alanine alkynyl amino acids, crosslink via a dialkyne bond with a second alkynyl amino acid
  misc_feature (4)..(11): Crosslink between residues
  MOD_RES (11)..(11): Alpha-Me S5-pentynyl-alanine alkynyl amino acids, wherein the alkyne forms one half of a dialkyne bond with a second alkynyl amino acid
  MOD_RES (17)..(17): D-amino acid
  C-term NH2
LTFAEYWAQLAAAAAAA

SEQ ID NO: 564 - protein, 17 aa, Artificial Sequence
  Description of Artificial Sequence: Synthetic peptide
  N-term Ac
  MOD_RES (4)..(4): Alpha-Me R9-nonynyl-alanine alkynyl amino acid crosslinked via an alkyne metathesis reaction with a second alkynyl amino acid
  misc_feature (4)..(11): Crosslink between residues
  MOD_RES (11)..(11): Alpha-Me S6-hexynyl-alanine alkynyl amino acid crosslinked via an alkyne metathesis reaction with a second alkynyl amino acid
  MOD_RES (17)..(17): D-amino acid
  C-term NH2
LTFAEYWAQLAAAAAAA

SEQ ID NO: 565 - protein, 17 aa, Artificial Sequence
  Description of Artificial Sequence: Synthetic peptide
  N-term Ac
  MOD_RES (4)..(4): Alpha-Me R9-nonynyl-alanine alkynyl amino acid crosslinked via an alkyne metathesis reaction with a second alkynyl amino acid
  misc_feature (4)..(11): Crosslink between residues
  MOD_RES (11)..(11): Alpha-Me S6-hexynyl-alanine alkynyl amino acid crosslinked via an alkyne metathesis reaction with a second alkynyl amino acid
  MOD_RES (17)..(17): D-amino acid
  C-term NH2
LTFAEYWAQLAAAAAAA

SEQ ID NO: 566 - protein, 14 aa, Artificial Sequence
  Description of Artificial Sequence: Synthetic peptide
  N-term Ac
  MOD_RES (4)..(4): Alpha-Me R9-nonynyl-alanine alkynyl amino acid crosslinked via an alkyne metathesis reaction with a second alkynyl amino acid
  misc_feature (4)..(11): Crosslink between residues
  MOD_RES (10)..(10): Cyclobutyl-Ala
  MOD_RES (11)..(11): Alpha-Me S6-hexynyl-alanine alkynyl amino acid crosslinked via an alkyne metathesis reaction with a second alkynyl amino acid
  C-term NH2
LTFAEYWAQAASAA

SEQ ID NO: 567 - protein, 14 aa, Artificial Sequence
  Description of Artificial Sequence: Synthetic peptide
  N-term Ac
  MOD_RES (4)..(4): Alpha-Me R9-nonynyl-alanine alkynyl amino acid crosslinked via an alkyne metathesis reaction with a second alkynyl amino acid
  misc_feature (4)..(11): Crosslink between residues
  MOD_RES (10)..(10): Cyclobutyl-Ala
  MOD_RES (11)..(11): Alpha-Me S6-hexynyl-alanine alkynyl amino acid crosslinked via an alkyne metathesis reaction with a second alkynyl amino acid
  C-term NH2
LTAAEYWAQAASAA

SEQ ID NO: 568 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R9-nonynyl-alanine alkynyl amino acid crosslinked via an alkyne metathesis reaction with a second alkynyl amino acid
  misc_feature (5)..(12): Crosslink between residues
  MOD_RES (11)..(11): Cyclobutyl-Ala
  MOD_RES (12)..(12): Alpha-Me S6-hexynyl-alanine alkynyl amino acid crosslinked via an alkyne metathesis reaction with a second alkynyl amino acid
  C-term NH2
ALTFAEYWAQAASAA

SEQ ID NO: 569 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAQLAAAAAAA

SEQ ID NO: 570 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid that is not connected by a crosslinker
  MOD_RES (12)..(12): Alpha-Me S5-pentenyl-alanine olefin amino acid that is not connected by a crosslinker
  MOD_RES (18)..(18): D-amino acid
  C-term NH2
ALTFAEYWAQLAAAAAAA

SEQ ID NO: 571 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTAAEYWAQLAAAAAAA

SEQ ID NO: 572 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAAYWAQLAAAAAAA

SEQ ID NO: 573 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
AATFAEYWAQLAAAAAAA

SEQ ID NO: 574 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALAFAEYWAQLAAAAAAA

SEQ ID NO: 575 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEAWAQLAAAAAAA

SEQ ID NO: 576 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYAAQLAAAAAAA

SEQ ID NO: 577 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTAAEYAAQLAAAAAAA

SEQ ID NO: 578 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAALAAAAAAA

SEQ ID NO: 579 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAQAAAAAAAA

SEQ ID NO: 580 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid that is not connected by a crosslinker
  MOD_RES (11)..(11): Cyclobutyl-Ala
  MOD_RES (12)..(12): Alpha-Me S5-pentenyl-alanine olefin amino acid that is not connected by a crosslinker
  C-term NH2
ALTFAEYWAQAASAA

SEQ ID NO: 581 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTAAEYWAQAASAA

SEQ ID NO: 582 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYAAQAASAA

SEQ ID NO: 583 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTAAEYAAQAASAA

SEQ ID NO: 584 - protein, 17 aa, Artificial Sequence
  Description of Artificial Sequence: Synthetic peptide
  N-term 5-FAM
  MOD_RES (1)..(1): Beta-Ala
  MOD_RES (8)..(8): Alpha-Me R8-octenyl-alanine olefin amino acid connected by an all-carbon crosslinker comprising one double bond
  misc_feature (8)..(15): Crosslink between residues
  MOD_RES (15)..(15): Alpha-Me S5-pentenyl-alanine olefin amino acid connected by an all-carbon crosslinker comprising one double bond
  C-term NH2
AQSQQTFANLWRLLAQN

SEQ ID NO: 585 - protein, 15 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 586 - protein, 15 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTAAEYWAQAASAA

SEQ ID NO: 587 - protein, 15 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYAAQAASAA

SEQ ID NO: 588 - protein, 15 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTAAEYAAQAASAA

SEQ ID NO: 589 - protein, 15 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid that is not connected by a crosslinker
  MOD_RES (11)..(11): Cyclobutyl-Ala
  MOD_RES (12)..(12): Alpha-Me S5-pentenyl-alanine olefin amino acid that is not connected by a crosslinker
  C-term NH2
ALTFAEYWAQAASAA

SEQ ID NO: 590 - protein, 18 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAQLAAAAAAA

SEQ ID NO: 591 - protein, 18 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTAAEYWAQLAAAAAAA

SEQ ID NO: 592 - protein, 18 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid that is not connected by a crosslinker
  MOD_RES (12)..(12): Alpha-Me S5-pentenyl-alanine olefin amino acid that is not connected by a crosslinker
  MOD_RES (18)..(18): D-amino acid
  C-term NH2
ALTFAEYWAQLAAAAAAA

SEQ ID NO: 593 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term OH
LTFAEYWXQAASAA

SEQ ID NO: 594 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term OH
LTFAEYWXQAAS

SEQ ID NO: 595 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTAAEYWXQAASAA

SEQ ID NO: 596 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYAXQAASAA

SEQ ID NO: 597 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTAAEYAXQAASAA

SEQ ID NO: 598 - protein, 14 aa, Artificial Sequence
  Description of Artificial Sequence: Synthetic peptide
  N-term Ac
  MOD_RES (4)..(4): Alpha-Me R8-octenyl-alanine olefin amino acid that is not connected by a crosslinker
  MOD_RES (8)..(8): Cou7
  MOD_RES (10)..(10): Cyclobutyl-Ala
  MOD_RES (11)..(11): Alpha-Me S5-pentenyl-alanine olefin amino acid that is not connected by a crosslinker
  C-term NH2
LTFAEYWXQAASAA

SEQ ID NO: 599 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWXQLAAAAAAA

SEQ ID NO: 600 - protein, 17 aa, Artificial Sequence
  Description of Artificial Sequence: Synthetic peptide
  N-term Ac
  MOD_RES (4)..(4): Alpha-Me R8-octenyl-alanine olefin amino acid that is not connected by a crosslinker
  MOD_RES (8)..(8): Cou7
  MOD_RES (11)..(11): Alpha-Me S5-pentenyl-alanine olefin amino acid that is not connected by a crosslinker
  MOD_RES (17)..(17): D-amino acid
  C-term NH2
LTFAEYWXQLAAAAAAA

SEQ ID NO: 601 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (11)..(11): Alpha-Me S5-pentenyl-alanine olefin amino acid connected by an all-carbon crosslinker comprising one double bond
  C-term OH
LTFAEYWXQLAAAAAA

SEQ ID NO: 602 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (11)..(11): Alpha-Me S5-pentenyl-alanine olefin amino acid connected by an all-carbon crosslinker comprising one double bond
  C-term OH
LTFAEYWXQLAAAAA

SEQ ID NO: 603 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (11)..(11): Alpha-Me S5-pentenyl-alanine olefin amino acid connected by an all-carbon crosslinker comprising one double bond
  C-term OH
LTFAEYWXQLAAAA

SEQ ID NO: 604 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (11)..(11): Alpha-Me S5-pentenyl-alanine olefin amino acid connected by an all-carbon crosslinker comprising one double bond
  C-term OH
LTFAEYWXQLAAA

SEQ ID NO: 605 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (11)..(11): Alpha-Me S5-pentenyl-alanine olefin amino acid connected by an all-carbon crosslinker comprising one double bond
  C-term OH
LTFAEYWXQLAA

SEQ ID NO: 606 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAASA

SEQ ID NO: 607 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAALAAAAAAA

SEQ ID NO: 608 - protein, 18 aa, Artificial Sequence
  Description of Artificial Sequence: Synthetic peptide
  N-term Biotin
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAQLAAAAAAA

SEQ ID NO: 609 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHAWAQLAS

SEQ ID NO: 610 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASA

SEQ ID NO: 611 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAHYWAQAASAA

SEQ ID NO: 612 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFASYWAQAASAA

SEQ ID NO: 613 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFARYWAQAASAA

SEQ ID NO: 614 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAKYWAQAASAA

SEQ ID NO: 615 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAAAAA

SEQ ID NO: 616 - protein, 19 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  MOD_RES (18)..(18): Beta-Ala
  C-term NH2
LTFAEYWAQLAAAAAAAAC

SEQ ID NO: 617 - protein, 19 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(18): D-amino acid
  MOD_RES (19)..(19): Peg4C
  C-term NH2
LTFAEYWAQLAAAAAAADC

SEQ ID NO: 618 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTAAAYWAALAAAAAAA

SEQ ID NO: 619 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYAAALAAAAAAA

SEQ ID NO: 620 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAAYWAALAAAAAAA

SEQ ID NO: 621 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTAAAYWAQLAAAAAAA

SEQ ID NO: 622 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYAAQLAAAAAAA

SEQ ID NO: 623 - protein, 17 aa, Artificial Sequence
  Description of Artificial Sequence: Synthetic peptide
  N-term Ac
  MOD_RES (4)..(4): Alpha-Me R6-hexynyl-alanine alkynyl amino acids, crosslink via a dialkyne bond with a second alkynyl amino acid
  misc_feature (4)..(11): Crosslink between residues
  MOD_RES (11)..(11): Alpha-Me S5-pentynyl-alanine alkynyl amino acids, wherein the alkyne forms one half of a dialkyne bond with a second alkynyl amino acid
  MOD_RES (17)..(17): D-amino acid
  C-term NH2
LTFAAYWAALAAAAAAA

SEQ ID NO: 624 - protein, 18 aa, Artificial Sequence
  Description of Artificial Sequence: Synthetic peptide
  N-term FITC
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAQLAAAAAAA

SEQ ID NO: 625 - protein, 15 aa, Artificial Sequence
  Description of Artificial Sequence: Synthetic peptide
  N-term FITC
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 626 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAEAAAAA

SEQ ID NO: 627 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAEAAAAA

SEQ ID NO: 628 - protein, 19 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  MOD_RES (18)..(18): Beta-Ala
  MOD_RES (19)..(19): Lys-bio
  C-term NH2
LTFAEYWAQLAAAAAAAAK

SEQ ID NO: 629 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAALAAAAAAA

SEQ ID NO: 630 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYAAALAAAAAAA

SEQ ID NO: 631 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYAAQLAAAAAAA

SEQ ID NO: 632 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAEAAAAA

SEQ ID NO: 633 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAEAAAAA

SEQ ID NO: 634 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQAASAAAAA

SEQ ID NO: 635 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Two pentenyl-alanine olefin side chains, each of which is crosslinked to another amino acid as indicated
  misc_feature (11)..(14): Crosslink between residues
  MOD_RES (15)..(15): Alpha-Me R5-pentenyl-alanine olefin amino acid connected by an all-carbon crosslinker comprising one double bond
  C-term NH2
LTFAEYWAQLAAAAAAA

SEQ ID NO: 636 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): Alpha-Me S5-pentenyl-alanine olefin amino acid connected by an all-carbon crosslinker comprising one double bond
  misc_feature (13)..(17): Crosslink between residues
  MOD_RES (17)..(17): Alpha-Me S5-pentenyl-alanine olefin amino acid connected by an all-carbon crosslinker comprising one double bond
  C-term NH2
LTFAEYWAQLAAAAAAAA

SEQ ID NO: 637 - protein, 19 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Alpha-Me S5-pentenyl-alanine olefin amino acid connected by an all-carbon crosslinker comprising one double bond
  misc_feature (14)..(18): Crosslink between residues
  MOD_RES (18)..(18): Alpha-Me S5-pentenyl-alanine olefin amino acid connected by an all-carbon crosslinker comprising one double bond
  C-term NH2
LTFAEYWAQLAAAAAAAAA

SEQ ID NO: 638 - protein, 20 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  misc_feature (15)..(19): Crosslink between residues
  MOD_RES (19)..(19): Alpha-Me S5-pentenyl-alanine olefin amino acid connected by an all-carbon crosslinker comprising one double bond
  C-term NH2
LTFAEYWAQLAAAAAAAAAA

SEQ ID NO: 639 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term OH
AAALTFAEYWAQLAAAA

SEQ ID NO: 640 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
AAALTFAEYWAQLAAAA

SEQ ID NO: 641 - protein, 18 aa, Artificial Sequence
  Description of Artificial Sequence: Synthetic peptide
  N-term Ac
  MOD_RES (8)..(8): Alpha-Me R8-octenyl-alanine olefin amino acid connected by an all-carbon crosslinker comprising one double bond
  misc_feature (8)..(15): Crosslink between residues
  MOD_RES (15)..(15): Alpha-Me S5-pentenyl-alanine olefin amino acid connected by an all-carbon crosslinker comprising one double bond
  C-term NH2
AAAALTFAEYWAQLAAAA

SEQ ID NO: 642 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  misc_feature (9)..(16): Crosslink between residues
  MOD_RES (16)..(16): Alpha-Me S5-pentenyl-alanine olefin amino acid connected by an all-carbon crosslinker comprising one double bond
  C-term NH2
AAAAALTFAEYWAQLAAAA

SEQ ID NO: 643 - protein, 20 aa, Artificial Sequence
  Description of Artificial Sequence: Synthetic peptide
  N-term Ac
  MOD_RES (10)..(10): Alpha-Me R8-octenyl-alanine olefin amino acid connected by an all-carbon crosslinker comprising one double bond
  misc_feature (10)..(17): Crosslink between residues
  MOD_RES (17)..(17): Alpha-Me S5-pentenyl-alanine olefin amino acid connected by an all-carbon crosslinker comprising one double bond
  C-term NH2
AAAAAALTFAEYWAQLAAAA

SEQ ID NO: 644 - protein, 14 aa, Artificial Sequence
  Description of Artificial Sequence: Synthetic peptide
  N-term Ac
  MOD_RES (4)..(4): Alpha-Me R6-hexynyl-alanine alkynyl amino acids, crosslink via a dialkyne bond with a second alkynyl amino acid
  misc_feature (4)..(11): Crosslink between residues
  MOD_RES (10)..(10): Cyclobutyl-Ala
  MOD_RES (11)..(11): Alpha-Me S6-hexynyl-alanine alkynyl amino acid wherein the alkyne forms one half of a dialkyne bond with a second alkynyl amino acid
  C-term NH2
LTFAEYWAQAASAA

SEQ ID NO: 645 - protein, 12 aa, Artificial Sequence
  Description of Artificial Sequence: Synthetic peptide
  N-term Ac
  MOD_RES (1)..(1): D-amino acid
  MOD_RES (2)..(2): Alpha-Me R5-pentenyl-alanine olefin amino acid connected by an all-carbon crosslinker comprising one double bond
  misc_feature (2)..(6): Crosslink between residues
  MOD_RES (3)..(5): D-amino acid
  MOD_RES (6)..(6): Alpha-Me R5-pentenyl-alanine olefin amino acid connected by an all-carbon crosslinker comprising one double bond
  MOD_RES (7)..(7): D-Phe-4CF3
  MOD_RES (8)..(12): D-amino acid
  C-term NH2
TAWYAAFEKLLR

SEQ ID NO: 646 - protein, 12 aa, Artificial Sequence
  Description of Artificial Sequence: Synthetic peptide
  N-term Ac
  MOD_RES (1)..(4): D-amino acid
  MOD_RES (5)..(5): Alpha-Me R5-pentenyl-alanine olefin amino acid connected by an all-carbon crosslinker comprising one double bond
  misc_feature (5)..(9): Crosslink between residues
  MOD_RES (6)..(6): D-amino acid
  MOD_RES (7)..(7): D-Phe-4CF3
  MOD_RES (8)..(8): D-amino acid
  MOD_RES (9)..(9): Alpha-Me R5-pentenyl-alanine olefin amino acid connected by an all-carbon crosslinker comprising one double bond
  MOD_RES (10)..(12): D-amino acid
  C-term NH2
TAWYANFEALLR

SEQ ID NO: 647 - protein, 12 aa, Artificial Sequence
  Description of Artificial Sequence: Synthetic peptide
  N-term Ac
  MOD_RES (1)..(5): D-amino acid
  MOD_RES (6)..(6): Alpha-Me R5-pentenyl-alanine olefin amino acid connected by an all-carbon crosslinker comprising one double bond
  misc_feature (6)..(10): Crosslink between residues
  MOD_RES (7)..(7): D-Phe-4CF3
  MOD_RES (8)..(9): D-amino acid
  MOD_RES (10)..(10): Alpha-Me R5-pentenyl-alanine olefin amino acid connected by an all-carbon crosslinker comprising one double bond
  MOD_RES (11)..(12): D-amino acid
  C-term NH2
TAWYAAFEKALR

SEQ ID NO: 648 - protein, 14 aa, Artificial Sequence
  Description of Artificial Sequence: Synthetic peptide
  N-term Ac
  MOD_RES (1)..(6): D-amino acid
  MOD_RES (7)..(7): D-Phe-4CF3
  MOD_RES (8)..(8): D-amino acid
  MOD_RES (9)..(9): Alpha-Me R5-pentenyl-alanine olefin amino acid connected by an all-carbon crosslinker comprising one double bond
  misc_feature (9)..(13): Crosslink between residues
  MOD_RES (10)..(12): D-amino acid
  MOD_RES (13)..(13): Alpha-Me R5-pentenyl-alanine olefin amino acid connected by an all-carbon crosslinker comprising one double bond
  MOD_RES (14)..(14): D-amino acid
  C-term NH2
TAWYANFEALLRAA

SEQ ID NO: 649 - protein, 12 aa, Artificial Sequence
  Description of Artificial Sequence: Synthetic peptide
  N-term Ac
  MOD_RES (1)..(1): D-amino acid
  MOD_RES (2)..(2): Alpha-Me S8-octenyl-alanine olefin amino acid connected by an all-carbon crosslinker comprising one double bond
  misc_feature (2)..(9): Crosslink between residues
  MOD_RES (3)..(6): D-amino acid
  MOD_RES (7)..(7): D-Phe-4CF3
  MOD_RES (8)..(8): D-amino acid
  MOD_RES (9)..(9): Alpha-Me R5-pentenyl-alanine olefin amino acid connected by an all-carbon crosslinker comprising one double bond
  MOD_RES (10)..(12): D-amino acid
  C-term NH2
TAWYANFEALLR

SEQ ID NO: 650 - protein, 13 aa, Artificial Sequence
  Description of Artificial Sequence: Synthetic peptide
  N-term Ac
  MOD_RES (1)..(4): D-amino acid
  MOD_RES (5)..(5): Alpha-Me S8-octenyl-alanine olefin amino acid connected by an all-carbon crosslinker comprising one double bond
  misc_feature (5)..(12): Crosslink between residues
  MOD_RES (6)..(6): D-amino acid
  MOD_RES (7)..(7): D-Phe-4CF3
  MOD_RES (8)..(11): D-amino acid
  MOD_RES (12)..(12): Alpha-Me R5-pentenyl-alanine olefin amino acid connected by an all-carbon crosslinker comprising one double bond
  MOD_RES (13)..(13): D-amino acid
  C-term NH2
TAWYANFEKLLAA

SEQ ID NO: 651 - protein, 14 aa, Artificial Sequence
  Description of Artificial Sequence: Synthetic peptide
  N-term Ac
  MOD_RES (1)..(5): D-amino acid
  MOD_RES (6)..(6): Alpha-Me S8-octenyl-alanine olefin amino acid connected by an all-carbon crosslinker comprising one double bond
  misc_feature (6)..(13): Crosslink between residues
  MOD_RES (7)..(7): D-Phe-4CF3
  MOD_RES (8)..(12): D-amino acid
  MOD_RES (13)..(13): Alpha-Me R5-pentenyl-alanine olefin amino acid connected by an all-carbon crosslinker comprising one double bond
  MOD_RES (14)..(14): D-amino acid
  C-term NH2
TAWYAAFEKLLRAA

SEQ ID NO: 652 - protein, 13 aa, Artificial Sequence
  Description of Artificial Sequence: Synthetic peptide
  N-term Ac
  MOD_RES (1)..(4): D-amino acid
  MOD_RES (5)..(5): Alpha-Me S8-octenyl-alanine olefin amino acid connected by an all-carbon crosslinker comprising one double bond
  misc_feature (5)..(12): Crosslink between residues
  MOD_RES (6)..(11): D-amino acid
  MOD_RES (12)..(12): Alpha-Me R5-pentenyl-alanine olefin amino acid connected by an all-carbon crosslinker comprising one double bond
  MOD_RES (13)..(13): D-amino acid
  C-term NH2
TAWYANAEKLLAA

SEQ ID NO: 653 - protein, 14 aa, Artificial Sequence
  Description of Artificial Sequence: Synthetic peptide
  N-term 5-FAM
  MOD_RES (1)..(1): Beta-Ala
  MOD_RES (2)..(5): D-amino acid
  MOD_RES (6)..(6): Alpha-Me S8-octenyl-alanine olefin amino acid connected by an all-carbon crosslinker comprising one double bond
  misc_feature (6)..(13): Crosslink between residues
  MOD_RES (7)..(7): D-amino acid
  MOD_RES (8)..(8): D-Phe-4CF3
  MOD_RES (9)..(12): D-amino acid
  MOD_RES (13)..(13): Alpha-Me R5-pentenyl-alanine olefin amino acid connected by an all-carbon crosslinker comprising one double bond
  MOD_RES (14)..(14): D-amino acid
  C-term NH2
ATAWYANFEKLLAA

SEQ ID NO: 654 - protein, 14 aa, Artificial Sequence
  Description of Artificial Sequence: Synthetic peptide
  N-term 5-FAM
  MOD_RES (1)..(1): Beta-Ala
  MOD_RES (2)..(5): D-amino acid
  MOD_RES (6)..(6): Alpha-Me S8-octenyl-alanine olefin amino acid connected by an all-carbon crosslinker comprising one double bond
  misc_feature (6)..(13): Crosslink between residues
  MOD_RES (7)..(12): D-amino acid
  MOD_RES (13)..(13): Alpha-Me R5-pentenyl-alanine olefin amino acid connected by an all-carbon crosslinker comprising one double bond
  MOD_RES (14)..(14): D-amino acid
  C-term NH2
ATAWYANAEKLLAA

SEQ ID NO: 655 - protein, 13 aa, Artificial Sequence
  Description of Artificial Sequence: Synthetic peptide
  N-term Ac
  MOD_RES (1)..(4): D-amino acid
  MOD_RES (5)..(5): Alpha-Me S8-octenyl-alanine olefin amino acid connected by an all-carbon crosslinker comprising one double bond
  misc_feature (5)..(12): Crosslink between residues
  MOD_RES (6)..(6): D-amino acid
  MOD_RES (7)..(7): D-Phe-4CF3
  MOD_RES (8)..(11): D-amino acid
  MOD_RES (12)..(12): Alpha-Me R5-pentenyl-alanine olefin amino acid connected by an all-carbon crosslinker comprising one double bond
  MOD_RES (13)..(13): D-amino acid
  C-term NH2
TAWYANFEALLAA

SEQ ID NO: 656 - protein, 17 aa, Artificial Sequence
  Description of Artificial Sequence: Synthetic peptide
  N-term Ac
  MOD_RES (1)..(4): D-amino acid
  MOD_RES (5)..(5): Alpha-Me S8-octenyl-alanine olefin amino acid connected by an all-carbon crosslinker comprising one double bond
  misc_feature (5)..(12): Crosslink between residues
  MOD_RES (6)..(6): D-amino acid
  MOD_RES (7)..(7): D-Phe-4CF3
  MOD_RES (8)..(11): D-amino acid
  MOD_RES (12)..(12): Alpha-Me R5-pentenyl-alanine olefin amino acid connected by an all-carbon crosslinker comprising one double bond
  MOD_RES (13)..(17): D-amino acid
  C-term NH2
TAWYANFEKLLAAAAAA

SEQ ID NO: 657 - protein, 17 aa, Artificial Sequence
  Description of Artificial Sequence: Synthetic peptide
  N-term Ac
  MOD_RES (1)..(4): D-amino acid
  MOD_RES (5)..(5): Alpha-Me S8-octenyl-alanine olefin amino acid connected by an all-carbon crosslinker comprising one double bond
  misc_feature (5)..(12): Crosslink between residues
  MOD_RES (6)..(6): D-amino acid
  MOD_RES (7)..(7): D-Phe-4CF3
  MOD_RES (8)..(11): D-amino acid
  MOD_RES (12)..(12): Alpha-Me R5-pentenyl-alanine olefin amino acid connected by an all-carbon crosslinker comprising one double bond
  MOD_RES (13)..(17): D-amino acid
  C-term NH2
TAWYANFEALLAAAAAA

SEQ ID NO: 658 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEFWAQAASALA

SEQ ID NO: 659 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 660 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 661 - protein, 20 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  MOD_RES (20)..(20): D-amino acid
  C-term NH2
AAALTFAEYWAQLAAAAAAA

SEQ ID NO: 662 - protein, 17 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 663 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  MOD_RES (17)..(17): D-amino acid
  C-term NH2
LTFAEYWAQLAAXAAAA

SEQ ID NO: 664 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): 2-aminoisobutyric acid
  MOD_RES (17)..(17): D-amino acid
  C-term NH2
LTFAEYWAQLAAAAXAA

SEQ ID NO: 665 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): 2-aminoisobutyric acid
  MOD_RES (17)..(17): D-amino acid
  C-term NH2
LTFAEYWAQLAAAAAXA

SEQ ID NO: 666 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): 2-aminoisobutyric acid
  C-term NH2
LTFAEYWAQLAAAAAAX

SEQ ID NO: 667 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(17): D-amino acid
  C-term NH2
LTFAEYWAQLAAAAAAA

SEQ ID NO: 668 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAAAAAAA

SEQ ID NO: 669 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): Sarcosine
  C-term NH2
LTFAEYWAQLAAAAAAX

SEQ ID NO: 670 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term OH
LTFAEYWAQLAAAAAAA

SEQ ID NO: 671 - protein, 17 aa, Artificial Sequence
  Description of Artificial Sequence: Synthetic peptide
  N-term Ac
  MOD_RES (4)..(4): Alpha-Me R6-hexynyl-alanine alkynyl amino acids, crosslink via a dialkyne bond with a second alkynyl amino acid
  misc_feature (4)..(11): Crosslink between residues
  MOD_RES (11)..(11): Alpha-Me S5-pentynyl-alanine alkynyl amino acids, wherein the alkyne forms one half of a dialkyne bond with a second alkynyl amino acid
  MOD_RES (17)..(17): D-amino acid
  C-term NH2
LTFAAYWAQLAAAAAAA

SEQ ID NO: 672 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 673 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEFWAQAAAAAAAA

SEQ ID NO: 674 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQAAAAAAAA

SEQ ID NO: 675 - protein, 16 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  MOD_RES (16)..(16): D-amino acid
  C-term NH2
TFAEYWAQLAAAAAAA

SEQ ID NO: 676 - protein, 15 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (15)..(15): D-amino acid
  C-term NH2
FAEYWAQLAAAAAAA

SEQ ID NO: 677 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LVFAEYWAQLAAAAAAA

SEQ ID NO: 678 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
AAFAEYWAQLAAAAAAA

SEQ ID NO: 679 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): D-amino acid
  C-term NH2
LTFAEYWAQLAAAAAA

SEQ ID NO: 680 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAAA

SEQ ID NO: 681 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAEYWAQLAAAA

SEQ ID NO: 682 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): D-amino acid
  C-term NH2
LTFAEYWAQLAAA

SEQ ID NO: 683 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): D-amino acid
  C-term NH2
LTFAEYWAQLAA

SEQ ID NO: 684 - protein, 17 aa, Artificial Sequence
  Description of Artificial Sequence: Synthetic peptide
  N-term Ac
  MOD_RES (4)..(4): Alpha-Me R6-hexynyl-alanine alkynyl amino acids, crosslink via a dialkyne bond with a second alkynyl amino acid
  misc_feature (4)..(11): Crosslink between residues
  MOD_RES (11)..(11): Alpha-Me S6-hexynyl-alanine alkynyl amino acids, crosslink via a dialkyne bond with a second alkynyl amino acid
  MOD_RES (17)..(17): D-amino acid
  C-term NH2
  see specification as filed for detailed description of substitutions and preferred embodiments
LTFAEYWAQLAAAAAAA

SEQ ID NO: 685 - protein, 16 aa, Artificial Sequence
  Description of Artificial Sequence: Synthetic peptide
  MOD_RES (2)..(2): Alpha-Me R5-pentenyl-alanine olefin amino acid connected by an all-carbon crosslinker comprising one double bond
  misc_feature (2)..(9): Crosslink between residues
  MOD_RES (9)..(9): Alpha-Me S8-octenyl-alanine olefin amino acid connected by an all-carbon crosslinker comprising one double bond
LAQETFSDAWKLLPEN

SEQ ID NO: 686 - protein, 16 aa, Artificial Sequence
  Description of Artificial Sequence: Synthetic peptide
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (11)..(11): Alpha-Me S8-octenyl-alanine olefin amino acid connected by an all-carbon crosslinker comprising one double bond
LSQATFSDLWALLPEN

SEQ ID NO: 687 - protein, 16 aa, Artificial Sequence
  Description of Artificial Sequence: Synthetic peptide
  MOD_RES (5)..(5): Alpha-Me R5-pentenyl-alanine olefin amino acid connected by an all-carbon crosslinker comprising one double bond
  misc_feature (5)..(12): Crosslink between residues
  MOD_RES (12)..(12): Alpha-Me S8-octenyl-alanine olefin amino acid connected by an all-carbon crosslinker comprising one double bond
LSQEAFSDLWKALPEN

SEQ ID NO: 688 - protein, 16 aa, Artificial Sequence
  Description of Artificial Sequence: Synthetic peptide
  MOD_RES (6)..(6): Alpha-Me R5-pentenyl-alanine olefin amino acid connected by an all-carbon crosslinker comprising one double bond
  misc_feature (6)..(13): Crosslink between residues
  MOD_RES (13)..(13): Alpha-Me S8-octenyl-alanine olefin amino acid connected by an all-carbon crosslinker comprising one double bond
LSQETASDLWKLAPEN

SEQ ID NO: 689 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQETFADLWKLLAEN

SEQ ID NO: 690 - protein, 16 aa, Artificial Sequence
  Description of Artificial Sequence: Synthetic peptide
  MOD_RES (2)..(2): Any amino acid
  MOD_RES (8)..(8): Alpha-Me R5-pentenyl-alanine olefin amino acid connected by an all-carbon crosslinker comprising one double bond
  misc_feature (8)..(15): Crosslink between residues
  MOD_RES (15)..(15): Alpha-Me S8-octenyl-alanine olefin amino acid connected by an all-carbon crosslinker comprising one double bond
LXQETFSALWKLLPAN

SEQ ID NO: 691 - protein, 16 aa, Artificial Sequence
  Description of Artificial Sequence: Synthetic peptide
  MOD_RES (9)..(9): Alpha-Me R5-pentenyl-alanine olefin amino acid connected by an all-carbon crosslinker comprising one double bond
  misc_feature (9)..(16): Crosslink between residues
  MOD_RES (16)..(16): Alpha-Me S8-octenyl-alanine olefin amino acid connected by an all-carbon crosslinker comprising one double bond
LSQETFSDAWKLLPEA

SEQ ID NO: 692 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQQTFADLWKLLAEN

SEQ ID NO: 693 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQETFADLWKLLAQN

SEQ ID NO: 694 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQQTFADLWKLLAQN

SEQ ID NO: 695 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQETFANLWKLLAQN

SEQ ID NO: 696 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQQTFANLWKLLAQN

SEQ ID NO: 697 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQQTFANLWRLLAQN

SEQ ID NO: 698 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
QSQQTFANLWKLLAQN

SEQ ID NO: 699 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
QSQQTFANLWRLLAQN

SEQ ID NO: 700 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
QSQQTAANLWRLLAQN

SEQ ID NO: 701 - protein, 16 aa, Artificial Sequence
  Description of Artificial Sequence: Synthetic peptide
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
LAQETFSDAWKLLPEN

SEQ ID NO: 702 - protein, 16 aa, Artificial Sequence
  Description of Artificial Sequence: Synthetic peptide
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
LSQATFSDLWALLPEN

SEQ ID NO: 703 - protein, 16 aa, Artificial Sequence
  Description of Artificial Sequence: Synthetic peptide
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
LSQEAFSDLWKALPEN

SEQ ID NO: 704 - protein, 16 aa, Artificial Sequence
  Description of Artificial Sequence: Synthetic peptide
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
LSQETASDLWKLAPEN

SEQ ID NO: 705 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQETFADLWKLLAEN

SEQ ID NO: 706 - protein, 16 aa, Artificial Sequence
  Description of Artificial Sequence: Synthetic peptide
  MOD_RES (2)..(2): Any amino acid
  MOD_RES (8)..(8): Alpha-Me R8-octenyl-alanine olefin amino acid connected by an all-carbon crosslinker comprising one double bond
  misc_feature (8)..(15): Crosslink between residues
  MOD_RES (15)..(15): Alpha-Me S5-pentenyl-alanine olefin amino acid connected by an all-carbon crosslinker comprising one double bond
LXQETFSALWKLLPAN

SEQ ID NO: 707 - protein, 16 aa, Artificial Sequence
  Description of Artificial Sequence: Synthetic peptide
  MOD_RES (9)..(9): Alpha-Me R8-octenyl-alanine olefin amino acid connected by an all-carbon crosslinker comprising one double bond
  misc_feature (9)..(16): Crosslink between residues
  MOD_RES (16)..(16): Alpha-Me S5-pentenyl-alanine olefin amino acid connected by an all-carbon crosslinker comprising one double bond
LSQETFSDAWKLLPEA

SEQ ID NO: 708 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQQTFADLWKLLAEN

SEQ ID NO: 709 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQETFADLWKLLAQN

SEQ ID NO: 710 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQQTFADLWKLLAQN

SEQ ID NO: 711 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQETFANLWKLLAQN

SEQ ID NO: 712 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQQTFANLWKLLAQN

SEQ ID NO: 713 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQQTFANLWRLLAQN

SEQ ID NO: 714 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
QSQQTFANLWKLLAQN

SEQ ID NO: 715 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
QSQQTFANLWRLLAQN

SEQ ID NO: 716 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
QSQQTAANLWRLLAQN

SEQ ID NO: 717 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
QSQQTFANLWRKKAQN

SEQ ID NO: 718 - protein, 14 aa, Artificial Sequence
  Description of Artificial Sequence: Synthetic peptide
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
QQTFADLWRLLAEN

SEQ ID NO: 719 - protein, 12 aa, Artificial Sequence
  Description of Artificial Sequence: Synthetic peptide
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
QQTFADLWRLLA

SEQ ID NO: 720 - protein, 13 aa, Artificial Sequence
  Description of Artificial Sequence: Synthetic peptide
  MOD_RES (7)..(7): Alpha-Me S5-pentenyl-alanine olefin amino acid connected by an all-carbon crosslinker comprising one double bond
  misc_feature (7)..(11): Crosslink between residues
  MOD_RES (11)..(11): Alpha-Me S5-pentenyl-alanine olefin amino acid connected by an all-carbon crosslinker comprising one double bond
LSQQTFADLWALL

SEQ ID NO: 721 - protein, 11 aa, Artificial Sequence
  Description of Artificial Sequence: Synthetic peptide
  MOD_RES (5)..(5): Alpha-Me S5-pentenyl-alanine olefin amino acid connected by an all-carbon crosslinker comprising one double bond
  misc_feature (5)..(9): Crosslink between residues
  MOD_RES (9)..(9): Alpha-Me S5-pentenyl-alanine olefin amino acid connected by an all-carbon crosslinker comprising one double bond
QQTFADLWALL

SEQ ID NO: 722 - protein, 14 aa, Artificial Sequence
  Description of Artificial Sequence: Synthetic peptide
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
QQTAADLWRLLAEN

SEQ ID NO: 723 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
QSQQTFANLWRLLAQN

SEQ ID NO: 724 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
QSQQTAANLWRLLAQN

SEQ ID NO: 725 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
QSQQTFADLWRLLAQN

SEQ ID NO: 726 - protein, 11 aa, Artificial Sequence
  Description of Artificial Sequence: Synthetic peptide
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
QTFANLWRLLA

SEQ ID NO: 727 - protein, 16 aa, Artificial Sequence
  Description of Artificial Sequence: Synthetic peptide
  MOD_RES (7)..(7): Alpha-Me S5-pentenyl-alanine olefin amino acid connected by an all-carbon crosslinker comprising one double bond
  misc_feature (7)..(11): Crosslink between residues
  MOD_RES (11)..(11): Alpha-Me S5-pentenyl-alanine olefin amino acid connected by an all-carbon crosslinker comprising one double bond
QSQQTFANLWALLPQN

SEQ ID NO: 728 - protein, 16 aa, Artificial Sequence
  Description of Artificial Sequence: Synthetic peptide
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (7)..(7): Alpha-Me S5-pentenyl-alanine olefin amino acid connected by an all-carbon crosslinker comprising one double bond
QSAQTFANLWRLLPQN

SEQ ID NO: 729 - protein, 10 aa, Artificial Sequence
  Description of Artificial Sequence: Synthetic peptide
  MOD_RES (1)..(1): Alpha-Me S5-pentenyl-alanine olefin amino acid connected by an all-carbon crosslinker comprising one double bond
  misc_feature (1)..(5): Crosslink between residues
  MOD_RES (5)..(5): Alpha-Me S5-pentenyl-alanine olefin amino acid connected by an all-carbon crosslinker comprising one double bond
ATFSALWKLL

SEQ ID NO: 730 - protein, 10 aa, Artificial Sequence
  Description of Artificial Sequence: Synthetic peptide
  MOD_RES (4)..(4): Alpha-Me S5-pentenyl-alanine olefin amino acid connected by an all-carbon crosslinker comprising one double bond
  misc_feature (4)..(8): Crosslink between residues
  MOD_RES (8)..(8): Alpha-Me S5-pentenyl-alanine olefin amino acid connected by an all-carbon crosslinker comprising one double bond
ETFADLWALL

SEQ ID NO: 731 - protein, 10 aa, Artificial Sequence
  Description of Artificial Sequence: Synthetic peptide
  MOD_RES (4)..(4): Alpha-Me S5-pentenyl-alanine olefin amino acid connected by an all-carbon crosslinker comprising one double bond
  misc_feature (4)..(8): Crosslink between residues
  MOD_RES (8)..(8): Alpha-Me S5-pentenyl-alanine olefin amino acid connected by an all-carbon crosslinker comprising one double bond
QTFANLWALL

SEQ ID NO: 732 - protein, 13 aa, Artificial Sequence
  Description of Artificial Sequence: Synthetic peptide
  MOD_RES (1)..(1): Alpha-Me S5-pentenyl-alanine olefin amino acid connected by an all-carbon crosslinker comprising one double bond
  misc_feature (1)..(5): Crosslink between residues
  MOD_RES (5)..(5): Alpha-Me S5-pentenyl-alanine olefin amino acid connected by an all-carbon crosslinker comprising one double bond
ASQEAFSNLWKLL

SEQ ID NO: 733 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
LSQETFADLWKLLAEN

SEQ ID NO: 734 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
LSQETFANLWKLLAQN

SEQ ID NO: 735 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
LSQQTFANLWRLLAQN

SEQ ID NO: 736 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWKLLAQN

SEQ ID NO: 737 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 738 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTAANLWRLLAQN

SEQ ID NO: 739 - protein, 16 aa, Artificial Sequence
  Description of Artificial Sequence: Synthetic peptide
  N-term Ac
  MOD_RES (2)..(2): 2-aminoisobutyric acid
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QXQQTFANLWRLLAQN

SEQ ID NO: 740 - protein, 16 aa, Artificial Sequence
  Description of Artificial Sequence: Synthetic peptide
  N-term Ac
  C-term NH2
QSQQTFSNLWRLLPQN

SEQ ID NO: 741 - protein, 16 aa, Artificial Sequence
  Description of Artificial Sequence: Synthetic peptide
  N-term Ac
  MOD_RES (7)..(7): Alpha-Me R8-octenyl-alanine olefin amino acid that is not connected by a crosslinker
  MOD_RES (14)..(14): Alpha-Me S5-pentenyl-alanine olefin amino acid that is not connected by a crosslinker
  C-term NH2
QSQQTFANLWRLLAQN

SEQ ID NO: 742 - protein, 16 aa, Artificial Sequence
  Description of Artificial Sequence: Synthetic peptide
  N-term Ac
  MOD_RES (4)..(4): 2-aminoisobutyric acid
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQXTFANLWRLLAQN

SEQ ID NO: 743 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLAAN

SEQ ID NO: 744 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
ASQQTFANLWRLLAQN

SEQ ID NO: 745 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFAALWRLLAQN

SEQ ID NO: 746 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQETFANLWRLLAQN

SEQ ID NO: 747 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQTFANLWRLLAQN

SEQ ID NO: 748 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQTFANLWRLLAEN

SEQ ID NO: 749 - protein, 16 aa, Artificial Sequence
  Description of Artificial Sequence: Synthetic peptide
  N-term Ac
  C-term NH2
LSQETFSDLWKLLPEN

SEQ ID NO: 750 - protein, 16 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  misc_feature (4)..(8): Crosslink between residues
  MOD_RES (8)..(8): Alpha-Me S5-pentenyl-alanine olefin amino acid connected by an all-carbon crosslinker comprising one double bond
  C-term NH2
QSQATFSALWRLLPQN

SEQ ID NO: 751 - protein, 16 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  misc_feature (5)..(9): Crosslink between residues
  MOD_RES (9)..(9): Alpha-Me S5-pentenyl-alanine olefin amino acid connected by an all-carbon crosslinker comprising one double bond
  C-term NH2
QSQQAFSNAWRLLPQN

SEQ ID NO: 752 - protein, 16 aa, Artificial Sequence
  Description of Artificial Sequence: Synthetic peptide
  N-term Ac
  MOD_RES (6)..(6): Alpha-Me S5-pentenyl-alanine olefin amino acid connected by an all-carbon crosslinker comprising one double bond
  misc_feature (6)..(10): Crosslink between residues
  MOD_RES (10)..(10): Alpha-Me S5-pentenyl-alanine olefin amino acid connected by an all-carbon crosslinker comprising one double bond
  C-term NH2
QSQQTASNLARLLPQN

SEQ ID NO: 753 - protein, 16 aa, Artificial Sequence
  Description of Artificial Sequence: Synthetic peptide
  N-term Ac
  MOD_RES (7)..(7): Alpha-Me S5-pentenyl-alanine olefin amino acid connected by an all-carbon crosslinker comprising one double bond
  misc_feature (7)..(11): Crosslink between residues
  MOD_RES (11)..(11): Alpha-Me S5-pentenyl-alanine olefin amino acid connected by an all-carbon crosslinker comprising one double bond
  C-term NH2
QSQQTFANLWALLPQN

SEQ ID NO: 754 - protein, 19 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (11)..(11): 2-aminoisobutyric acid
  MOD_RES (13)..(13): Norleucine
  MOD_RES (14)..(14): Alpha-Me S5-pentenyl-alanine olefin amino acid connected by an all-carbon crosslinker comprising one double bond
  MOD_RES (17)..(17): 2-aminoisobutyric acid
  C-term NH2
RTQATFANQWXALATNXTR

SEQ ID NO: 755 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLARN

SEQ ID NO: 756 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQRTFANLWRLLAQN

SEQ ID NO: 757 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (9)..(9): Norleucine
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 758 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (12)..(12): Norleucine
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 759 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (13)..(13): Norleucine
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 760 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTYANLWRLLAQN

SEQ ID NO: 761 - protein, 16 aa, Artificial Sequence
  Description of Artificial Sequence: Synthetic peptide
  N-term Ac
  MOD_RES (2)..(2): 2-aminoisobutyric acid
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RXQQTFANLWRLLAQN

SEQ ID NO: 762 - protein, 12 aa, Artificial Sequence
  Description of Artificial Sequence: Synthetic peptide
  N-term Ac
  C-term NH2
MPRFMDYWEGLN

SEQ ID NO: 763 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQRFANLWRLLAQN

SEQ ID NO: 764 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQRFANLWRLLAQN

SEQ ID NO: 765 - protein, 16 aa, Artificial Sequence
  Description of Artificial Sequence: Synthetic peptide
  N-term Ac
  MOD_RES (2)..(2): 2-aminoisobutyric acid
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RXQQRFANLWRLLAQN

SEQ ID NO: 766 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQRFANFWRLLAQN

SEQ ID NO: 767 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQRFANYWRLLAQN

SEQ ID NO: 768 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQTFANLWQLLAQN

SEQ ID NO: 769 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (12)..(12): Alpha-Me-Leu
  MOD_RES (14)..(14): Alpha-Me S5-pentenyl-alanine olefin amino acid connected by an all-carbon crosslinker comprising one double bond
  C-term NH2
QSQQTFANLWQLLAQN

SEQ ID NO: 770 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (9)..(9): Alpha-Me-Leu
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 771 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFADYWEGLAQN

SEQ ID NO: 772 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFANYWRLLAQN

SEQ ID NO: 773 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
RFANLWRLLAQ

SEQ ID NO: 774 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (9)..(9): 2-fluoro-Phe
  MOD_RES (14)..(14): Alpha-Me S5-pentenyl-alanine olefin amino acid connected by an all-carbon crosslinker comprising one double bond
  C-term NH2
QSQQTFANFWRLLAQN

SEQ ID NO: 775 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (9)..(9): 3-fluoro-Phe
  MOD_RES (14)..(14): Alpha-Me S5-pentenyl-alanine olefin amino acid connected by an all-carbon crosslinker comprising one double bond
  C-term NH2
QSQQTFANFWRLLAQN

SEQ ID NO: 776 - protein, 16 aa, Artificial Sequence
  Description of Artificial Sequence: Synthetic peptide
  N-term Ac
  MOD_RES (7)..(7): Alpha-hydrogen R8-octenyl-alanine olefin amino acid connected by an all-carbon saturated crosslinker with no double bond
  misc_feature (7)..(14): Crosslink between residues
  MOD_RES (14)..(14): Alpha-hydrogen S5-pentenyl-alanine olefin amino acid connected by an all-carbon saturated crosslinker with no double bond
  C-term NH2
QSQQTFANLWRLLAQN

SEQ ID NO: 777 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQTAANLWRLLAQN

SEQ ID NO: 778 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising no double bonds
  misc_feature (7)..(14): Crosslink between residues
  MOD_RES (14)..(14): Alpha-Me S5-pentenyl-alanine olefin amino acid connected by an all-carbon crosslinker comprising no double bonds
  C-term NH2
QSQQTFANLWRLLAQN

SEQ ID NO: 779 - protein, 16 aa, Artificial Sequence
  Description of Artificial Sequence: Synthetic peptide
  N-term acetylated with heptanoic acid and connected to internal olefin amino acid by an all-carbon crosslinker to position 4 comprising one double bond
  MOD_RES (4)..(4): Alpha-Me S5-pentenyl-alanine olefin amino acid connected by an all-carbon crosslinker to the N-term comprising one double bond
  C-term NH2
QSQATFSNLWRLLPQN

SEQ ID NO: 780 - protein, 16 aa, Artificial Sequence
  Description of Artificial Sequence: Synthetic peptide
  N-term acetylated with heptanoic acid and connected to internal olefin amino acid by an all-carbon crosslinker to position 4 comprising one double bond
  MOD_RES (4)..(4): Alpha-Me S5-pentenyl-alanine olefin amino acid connected by an all-carbon crosslinker to the N-term comprising one double bond
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQATFANLWRLLAQN

SEQ ID NO: 781 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (10)..(10): 6cl-Trp
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 782 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (10)..(10): Me6cl-Trp
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 783 - protein, 12 aa, Artificial Sequence
  Description of Artificial Sequence: Synthetic peptide
  N-term Ac
  C-term NH2
LTFEHYWAQLTS

SEQ ID NO: 784 - protein, 12 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  misc_feature (4)..(8): Crosslink between residues
  MOD_RES (8)..(8): Alpha-Me S5-pentenyl-alanine olefin amino acid connected by an all-carbon crosslinker comprising one double bond
  C-term NH2
LTFAHYWAQLTS

SEQ ID NO: 785 - protein, 12 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  misc_feature (5)..(9): Crosslink between residues
  MOD_RES (9)..(9): Alpha-Me S5-pentenyl-alanine olefin amino acid connected by an all-carbon crosslinker comprising one double bond
  C-term NH2
LTFEAYWAALTS

SEQ ID NO: 786 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one Z configured double bond
  misc_feature (4)..(11): Crosslink between residues
  MOD_RES (11)..(11): Alpha-Me S5-pentenyl-alanine olefin amino acid connected by an all-carbon crosslinker comprising one Z configured double bond
  C-term NH2
LTFAHYWAQLAS

SEQ ID NO: 787 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWRQLAS

SEQ ID NO: 788 - protein, 16 aa, Artificial Sequence
  Description of Artificial Sequence: Synthetic peptide
  N-term Ac
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (7)..(7): Two pentenyl-alanine olefin side chains, each of which is crosslinked to another amino acid as indicated
  misc_feature (7)..(14): Crosslink between residues
  MOD_RES (14)..(14): Alpha-Me S8-octenyl-alanine olefin amino acid connected by an all-carbon crosslinker comprising one double bond
  C-term NH2
QSAQTFANLWRLLAQN

SEQ ID NO: 789 - protein, 16 aa, Artificial Sequence
  Description of Artificial Sequence: Synthetic peptide
  N-term Ac
  C-term NH2
QSQQTASNLWRLLPQN

SEQ ID NO: 790 - protein, 16 aa, Artificial Sequence
  Description of Artificial Sequence: Synthetic peptide
  N-term Ac
  MOD_RES (7)..(7): Alpha-Me R8-octenyl-alanine olefin amino acid that is not connected by a crosslinker
  MOD_RES (14)..(14): Alpha-Me S5-pentenyl-alanine olefin amino acid that is not connected by a crosslinker
  C-term NH2
QSQQTAANLWRLLAQN

SEQ ID NO: 791 - protein, 16 aa, Artificial Sequence
  Description of Artificial Sequence: Synthetic peptide
  N-term Ac
  MOD_RES (7)..(7): Alpha-Me R8-octenyl-alanine olefin amino acid that is not connected by a crosslinker
  MOD_RES (14)..(14): Alpha-Me S5-pentenyl-alanine olefin amino acid that is not connected by a crosslinker
  C-term NH2
ASQQTFANLWRLLAQN

SEQ ID NO: 792 - protein, 16 aa, Artificial Sequence
  Description of Artificial Sequence: Synthetic peptide
  N-term Ac
  MOD_RES (1)..(1): Alpha-Me S5-pentenyl-alanine olefin amino acid connected by an all-carbon crosslinker comprising one double bond
  misc_feature (1)..(5): Crosslink between residues
  MOD_RES (5)..(5): Alpha-Me S5-pentenyl-alanine olefin amino acid connected by an all-carbon crosslinker comprising one double bond
  MOD_RES (14)..(14): 2-aminoisobutyric acid
  C-term NH2
ASQQAFSNLWRLLXQN

SEQ ID NO: 793 - protein, 16 aa, Artificial Sequence
  Description of Artificial Sequence: Synthetic peptide
  N-term Ac
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (7)..(7): Alpha-Me S5-pentenyl-alanine olefin amino acid connected by an all-carbon crosslinker comprising one double bond
  MOD_RES (14)..(14): 2-aminoisobutyric acid
  C-term NH2
QSAQTFANLWRLLXQN

SEQ ID NO: 794 - protein, 16 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  misc_feature (5)..(9): Crosslink between residues
  MOD_RES (9)..(9): Alpha-Me S5-pentenyl-alanine olefin amino acid connected by an all-carbon crosslinker comprising one double bond
  MOD_RES (14)..(14): 2-aminoisobutyric acid
  C-term NH2
QSQQAFSNAWRLLXQN

SEQ ID NO: 795 - protein, 16 aa, Artificial Sequence
  Description of Artificial Sequence: Synthetic peptide
  N-term Ac
  MOD_RES (7)..(7): Alpha-Me S5-pentenyl-alanine olefin amino acid connected by an all-carbon crosslinker comprising one double bond
  misc_feature (7)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
QSQQTFANLWALLXQN

SEQ ID NO: 796 - protein, 16 aa, Artificial Sequence
  Description of Artificial Sequence: Synthetic peptide
  N-term Ac
  MOD_RES (8)..(8): Alpha-Me S5-pentenyl-alanine olefin amino acid connected by an all-carbon crosslinker comprising one double bond
  misc_feature (8)..(12): Crosslink between residues
  MOD_RES (12)..(12): Alpha-Me S5-pentenyl-alanine olefin amino acid connected by an all-carbon crosslinker comprising one double bond
  MOD_RES (14)..(14): 2-aminoisobutyric acid
  C-term NH2
QSQQTFSALWRALXQN

SEQ ID NO: 797 - protein, 16 aa, Artificial Sequence
  Description of Artificial Sequence: Synthetic peptide
  N-term Ac
  MOD_RES (11)..(11): Alpha-Me S5-pentenyl-alanine olefin amino acid connected by an all-carbon crosslinker comprising one double bond
  misc_feature (11)..(15): Crosslink between residues
  MOD_RES (15)..(15): Alpha-Me S5-pentenyl-alanine olefin amino acid connected by an all-carbon crosslinker comprising one double bond
  C-term NH2
QSQQTFSNLWALLAAN

SEQ ID NO: 798 - protein, 16 aa, Artificial Sequence
  Description of Artificial Sequence: Synthetic peptide
  N-term Ac
  MOD_RES (1)..(1): Alpha-Me S5-pentenyl-alanine olefin amino acid that is not connected by a crosslinker
  MOD_RES (5)..(5): Alpha-Me S5-pentenyl-alanine olefin amino acid that is not connected by a crosslinker
  MOD_RES (14)..(14): 2-aminoisobutyric acid
  C-term NH2
ASQQAFSNLWRLLXQN

SEQ ID NO: 799 - protein, 16 aa, Artificial Sequence
  Description of Artificial Sequence: Synthetic peptide
  N-term Ac
  MOD_RES (3)..(3): Alpha-Me S5-pentenyl-alanine olefin amino acid that is not connected by a crosslinker
  MOD_RES (7)..(7): Alpha-Me S5-pentenyl-alanine olefin amino acid that is not connected by a crosslinker
  MOD_RES (14)..(14): 2-aminoisobutyric acid
  C-term NH2
QSAQTFANLWRLLXQN

SEQ ID NO: 800 - protein, 16 aa, Artificial Sequence
  Description of Artificial Sequence: Synthetic peptide
  N-term Ac
  MOD_RES (5)..(5): Alpha-Me S5-pentenyl-alanine olefin amino acid that is not connected by a crosslinker
  MOD_RES (9)..(9): Alpha-Me S5-pentenyl-alanine olefin amino acid that is not connected by a crosslinker
  MOD_RES (14)..(14): 2-aminoisobutyric acid
  C-term NH2
QSQQAFSNAWRLLXQN

SEQ ID NO: 801 - protein, 16 aa, Artificial Sequence
  Description of Artificial Sequence: Synthetic peptide
  N-term Ac
  MOD_RES (7)..(7): Alpha-Me S5-pentenyl-alanine olefin amino acid that is not connected by a crosslinker
  MOD_RES (11)..(11): Alpha-Me S5-pentenyl-alanine olefin amino acid that is not connected by a crosslinker
  MOD_RES (14)..(14): 2-aminoisobutyric acid
  C-term NH2
QSQQTFANLWALLXQN

SEQ ID NO: 802 - protein, 16 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  misc_feature (4)..(8): Crosslink between residues
  MOD_RES (8)..(8): Alpha-Me S5-pentenyl-alanine olefin amino acid connected by an all-carbon crosslinker comprising one double bond
  MOD_RES (14)..(14): 2-aminoisobutyric acid
  C-term NH2
QSQATFSALWRLLXQN

SEQ ID NO: 803 - protein, 16 aa, Artificial Sequence
  Description of Artificial Sequence: Synthetic peptide
  N-term Ac
  MOD_RES (4)..(4): Alpha-Me S5-pentenyl-alanine olefin amino acid that is not connected by a crosslinker
  MOD_RES (8)..(8): Alpha-Me S5-pentenyl-alanine olefin amino acid that is not connected by a crosslinker
  MOD_RES (14)..(14): 2-aminoisobutyric acid
  C-term NH2
QSQATFSALWRLLXQN

SEQ ID NO: 804 - protein, 16 aa, Artificial Sequence
  Description of Artificial Sequence: Synthetic peptide
  N-term Ac
  MOD_RES (3)..(3): Alpha-Me S5-pentenyl-alanine olefin amino acid not connected by any crosslinker
  MOD_RES (7)..(7): Amino acid comprising two pentenyl-alanine olefin side chains that are not crosslinked
  MOD_RES (14)..(14): Alpha-Me S8-octenyl-alanine olefin amino acid not connected by any crosslinker
  C-term NH2
QSAQTFANLWRLLAQN

SEQ ID NO: 805 - protein, 16 aa, Artificial Sequence
  Description of Artificial Sequence: Synthetic peptide
  N-term Ac
  MOD_RES (1)..(1): Alpha-Me R8-octenyl-alanine olefin amino acid connected by an all-carbon crosslinker comprising one double bond
  misc_feature (1)..(8): Crosslink between residues
  MOD_RES (8)..(8): Alpha-Me S5-pentenyl-alanine olefin amino acid connected by an all-carbon crosslinker comprising one double bond
  MOD_RES (14)..(14): 2-aminoisobutyric acid
  C-term NH2
ASQQTFSALWRLLXQN

SEQ ID NO: 806 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
QSQATFSNLWALLXQN

SEQ ID NO: 807 - protein, 16 aa, Artificial Sequence
  Description of Artificial Sequence: Synthetic peptide
  N-term Ac
  MOD_RES (8)..(8): Alpha-Me R8-octenyl-alanine olefin amino acid connected by an all-carbon crosslinker comprising one double bond
  misc_feature (8)..(15): Crosslink between residues
  MOD_RES (15)..(15): Alpha-Me S5-pentenyl-alanine olefin amino acid connected by an all-carbon crosslinker comprising one double bond
  C-term NH2
QSQQTFSALWRLLAAN

SEQ ID NO: 808 - protein, 16 aa, Artificial Sequence
  Description of Artificial Sequence: Synthetic peptide
  N-term Ac
  MOD_RES (3)..(3): Alpha-Me R5-pentenyl-alanine olefin amino acid connected by an all-carbon crosslinker comprising one double bond
  misc_feature (3)..(7): Crosslink between residues
  MOD_RES (7)..(7): Two pentenyl-alanine olefin side chains, each of which is crosslinked to another amino acid as indicated
  misc_feature (7)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
QSAQTFANLWALLXQN

SEQ ID NO: 809 - protein, 16 aa, Artificial Sequence
  Description of Artificial Sequence: Synthetic peptide
  N-term Ac
  MOD_RES (1)..(1): Alpha-Me R8-octenyl-alanine olefin amino acid that is not connected by a crosslinker
  MOD_RES (8)..(8): Alpha-Me S5-pentenyl-alanine olefin amino acid that is not connected by a crosslinker
  MOD_RES (14)..(14): 2-aminoisobutyric acid
  C-term NH2
ASQQTFSALWRLLXQN

SEQ ID NO: 810 - protein, 16 aa, Artificial Sequence
  Description of Artificial Sequence: Synthetic peptide
  N-term Ac
  MOD_RES (4)..(4): Alpha-Me R8-octenyl-alanine olefin amino acid that is not connected by a crosslinker
  MOD_RES (11)..(11): Alpha-Me S5-pentenyl-alanine olefin amino acid that is not connected by a crosslinker
  MOD_RES (14)..(14): 2-aminoisobutyric acid
  C-term NH2
QSQATFSNLWALLXQN

SEQ ID NO: 811 - protein, 16 aa, Artificial Sequence
  Description of Artificial Sequence: Synthetic peptide
  N-term Ac
  MOD_RES (8)..(8): Alpha-Me R8-octenyl-alanine olefin amino acid that is not connected by a crosslinker
  MOD_RES (15)..(15): Alpha-Me S5-pentenyl-alanine olefin amino acid that is not connected by a crosslinker
  C-term NH2
QSQQTFSALWRLLAAN

SEQ ID NO: 812 - protein, 16 aa, Artificial Sequence
  Description of Artificial Sequence: Synthetic peptide
  N-term Ac
  MOD_RES (3)..(3): Alpha-Me R5-pentenyl-alanine olefin amino acid that is not connected by a crosslinker
  MOD_RES (7)..(7): Amino acid comprising two pentenyl-alanine olefin side chains that are not crosslinked
  MOD_RES (11)..(11): Alpha-Me S5-pentenyl-alanine olefin amino acid that is not connected by a crosslinker
  MOD_RES (14)..(14): 2-aminoisobutyric acid
  C-term NH2
QSAQTFANLWALLXQN

SEQ ID NO: 813 - protein, 16 aa, Artificial Sequence
  Description of Artificial Sequence: Synthetic peptide
  N-term Ac
  MOD_RES (14)..(14): 2-aminoisobutyric acid
  C-term NH2
QSQQTFSNLWRLLXQN

SEQ ID NO: 814 - protein, 16 aa, Artificial Sequence
  Description of Artificial Sequence: Synthetic peptide
  N-term acetylated with heptanoic acid
  MOD_RES (4)..(4): Alpha-Me S5-pentenyl-alanine olefin amino acid that is not connected by a crosslinker
  MOD_RES (7)..(7): Alpha-Me R8-octenyl-alanine olefin amino acid that is not connected by a crosslinker
  MOD_RES (14)..(14): Alpha-Me S5-pentenyl-alanine olefin amino acid that is not connected by a crosslinker
  C-term NH2
QSQATFANLWRLLAQN

SEQ ID NO: 815 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
ASQQTFANLRWLLAQN

SEQ ID NO: 816 - protein, 15 aa, Artificial Sequence
  Description of Artificial Sequence: Synthetic peptide
  N-term Ac
  MOD_RES (7)..(7): Alpha-Me R8-octenyl-alanine olefin amino acid that is not connected by a crosslinker
  MOD_RES (14)..(14): Alpha-Me S5-pentenyl-alanine olefin amino acid that is not connected by a crosslinker
  C-term NH2
QSQQTFANLWRLLAQ

SEQ ID NO: 817 - protein, 15 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLAQ

SEQ ID NO: 818 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
AAARAAAAAARAAAAA

SEQ ID NO: 819 - protein, 13 aa, Artificial Sequence
  Description of Artificial Sequence: Synthetic peptide
  N-term Ac
  C-term NH2
LTFEHYWAQLTSA

SEQ ID NO: 820 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLASA

SEQ ID NO: 821 - protein, 16 aa, Artificial Sequence
  Description of Artificial Sequence: Synthetic peptide
  N-term Ac
  C-term NH2
ASQQTFSNLWRLLPQN

SEQ ID NO: 822 - protein, 16 aa, Artificial Sequence
  Description of Artificial Sequence: Synthetic peptide
  N-term Ac
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (7)..(7): Two pentenyl-alanine olefin side chains, each of which is crosslinked to another amino acid as indicated
  misc_feature (7)..(11): Crosslink between residues
  MOD_RES (11)..(11): Alpha-Me R5-pentenyl-alanine olefin amino acid connected by an all-carbon crosslinker comprising one double bond
  MOD_RES (14)..(14): 2-aminoisobutyric acid
  C-term NH2
QSAQTFANLWALLXQN

SEQ ID NO: 823 - protein, 16 aa, Artificial Sequence
  Description of Artificial Sequence: Synthetic peptide
  N-term Ac
  MOD_RES (7)..(7): 2-aminoisobutyric acid
  MOD_RES (14)..(14): 2-aminoisobutyric acid
  C-term NH2
QSQQTFXNLWRLLXQN

SEQ ID NO: 824 - protein, 16 aa, Artificial Sequence
  Description of Artificial Sequence: Synthetic peptide
  N-term Ac
  MOD_RES (7)..(7): Norleucine
  MOD_RES (14)..(14): Norleucine
  C-term NH2
QSQQTFLNLWRLLLQN

SEQ ID NO: 825 - protein, 16 aa, Artificial Sequence
  Description of Artificial Sequence: Synthetic peptide
  N-term Ac
  MOD_RES (7)..(7): Alpha-Me R8-octenyl-alanine olefin amino acid that is not connected by a crosslinker
  MOD_RES (14)..(14): 2-aminoisobutyric acid
  C-term NH2
QSQQTFANLWRLLXQN

SEQ ID NO: 826 - protein, 16 aa, Artificial Sequence
  Description of Artificial Sequence: Synthetic peptide
  N-term Ac
  MOD_RES (7)..(7): Alpha-Me R8-octenyl-alanine olefin amino acid that is not connected by a crosslinker
  MOD_RES (14)..(14): Norleucine
  C-term NH2
QSQQTFANLWRLLLQN

SEQ ID NO: 827 - protein, 16 aa, Artificial Sequence
  Description of Artificial Sequence: Synthetic peptide
  N-term Ac
  MOD_RES (7)..(7): 2-aminoisobutyric acid
  MOD_RES (14)..(14): Alpha-Me S5-pentenyl-alanine olefin amino acid that is not connected by a crosslinker
  C-term NH2
QSQQTFXNLWRLLAQN

SEQ ID NO: 828 - protein, 16 aa, Artificial Sequence
  Description of Artificial Sequence: Synthetic peptide
  N-term Ac
  MOD_RES (7)..(7): Norleucine
  MOD_RES (14)..(14): Alpha-Me S5-pentenyl-alanine olefin amino acid that is not connected by a crosslinker
  C-term NH2
QSQQTFLNLWRLLAQN

SEQ ID NO: 829 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising no double bonds
  misc_feature (7)..(14): Crosslink between residues
  MOD_RES (10)..(10): 6cl-Trp
  MOD_RES (12)..(12): Norleucine
  MOD_RES (14)..(14): Alpha-Me S5-pentenyl-alanine olefin amino acid connected by an all-carbon crosslinker comprising no double bonds
  C-term NH2
QSQQTFANLWRLLAQN

SEQ ID NO: 830 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising no double bonds
  misc_feature (7)..(3): Crosslink between residues
  MOD_RES (10)..(10): Me6clW
  MOD_RES (14)..(14): Alpha-Me S5-pentenyl-alanine olefin amino acid connected by an all-carbon crosslinker comprising no double bonds
  C-term NH2
QSQQTFANLWRLLAQN

SEQ ID NO: 831 - protein, 8 aa, Artificial Sequence
  Description of Artificial Sequence: Synthetic peptide
  N-term Ac
  MOD_RES (2)..(2): Norleucine
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (7)..(7): Alpha-Me S5-pentenyl-alanine olefin amino acid connected by an all-carbon crosslinker comprising one double bond
  C-term NH2
FLAYWEAL

SEQ ID NO: 832 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWELLAA

SEQ ID NO: 833 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWQLLAA

SEQ ID NO: 834 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFANYWELLAQN

SEQ ID NO: 835 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFADYWRLLAQN

SEQ ID NO: 836 - protein, 13 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFANYWRLLAQ

SEQ ID NO: 837 - protein, 12 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFANYWRLLA

SEQ ID NO: 838 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFADLWRLLAQN

SEQ ID NO: 839 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLAEN

SEQ ID NO: 840 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLAQD

SEQ ID NO: 841 - protein, 15 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLAS

SEQ ID NO: 842 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
ESQQTFANLWRLLAQN

SEQ ID NO: 843 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFANLWRLLAQ

SEQ ID NO: 844 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LRFANLWRLLAQ

SEQ ID NO: 845 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (12)..(12): Norleucine
  MOD_RES (14)..(14): Alpha-Me S5-pentenyl-alanine olefin amino acid connected by an all-carbon crosslinker comprising one double bond
  C-term NH2
QSQQTFANWWRLLAQN

SEQ ID NO: 846 - protein, 15 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (12)..(12): Norleucine
  MOD_RES (14)..(14): Alpha-Me S5-pentenyl-alanine olefin amino acid connected by an all-carbon crosslinker comprising one double bond
  C-term NH2
QSQQTFANLWRLLAQ

SEQ ID NO: 847 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
QTFANLWRLLAQN

SEQ ID NO: 848 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFANWWRLLAQN

SEQ ID NO: 849 - protein, 13 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFANWWRLLAA

SEQ ID NO: 850 - protein, 10 aa, Artificial Sequence
  Description of Artificial Sequence: Synthetic peptide
  N-term Ac
  C-term NH2
TSFAEYWNLL

SEQ ID NO: 851 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
QTFAHWWSQLAS

SEQ ID NO: 852 - protein, 8 aa, Artificial Sequence
  Description of Artificial Sequence: Synthetic peptide
  N-term Ac
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (7)..(7): Alpha-Me S5-pentenyl-alanine olefin amino acid connected by an all-carbon crosslinker comprising one double bond
  C-term NH2
FMAYWEAL

SEQ ID NO: 853 - protein, 12 aa, Artificial Sequence
  Description of Artificial Sequence: Synthetic peptide
  N-term Ac
  C-term NH2
QTFEHWWSQLLS

SEQ ID NO: 854 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (10)..(10): Alpha-Me-Trp
  MOD_RES (13)..(13): Norleucine
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 855 - protein, 8 aa, Artificial Sequence
  Description of Artificial Sequence: Synthetic peptide
  N-term Ac
  MOD_RES (3)..(3): 2-aminoisobutyric acid
  MOD_RES (5)..(5): 6cl-Trp
  MOD_RES (7)..(7): Ac3c
  C-term NH2
FMXYWEXL

SEQ ID NO: 856 - protein, 8 aa, Artificial Sequence
  Description of Artificial Sequence: Synthetic peptide
  N-term Ac
  MOD_RES (2)..(2): Norleucine
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (5)..(5): 6cl-Trp
  MOD_RES (7)..(7): Alpha-Me S5-pentenyl-alanine olefin amino acid connected by an all-carbon crosslinker comprising one double bond
  C-term NH2
FLAYWEAL

SEQ ID NO: 857 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one Z configured double bond
  misc_feature (2)..(9): Crosslink between residues
  MOD_RES (5)..(5): 6cl-Trp
  MOD_RES (7)..(7): Ac3c
  MOD_RES (9)..(9): Alpha-Me S5-pentenyl-alanine olefin amino acid connected by an all-carbon crosslinker comprising one Z configured double bond
  C-term NH2
FAAYWEXLA

SEQ ID NO: 858 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 859 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (8)..(8): 6cl-Trp
  MOD_RES (12)..(12): Alpha-Me S5-pentenyl-alanine olefin amino acid connected by an all-carbon crosslinker comprising one double bond
  C-term NH2
LPRFANYWRLLAQN

SEQ ID NO: 860 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
AFAAAWALAAA

SEQ ID NO: 861 - protein, 11 aa, Artificial Sequence
  Description of Artificial Sequence: Synthetic peptide
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWRLAAQ

SEQ ID NO: 862 - protein, 11 aa, Artificial Sequence
  Description of Artificial Sequence: Synthetic peptide
  N-term Pr
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWRLAAQ

SEQ ID NO: 863 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising no double bonds
  misc_feature (7)..(14): Crosslink between residues
  MOD_RES (12)..(12): Norleucine
  MOD_RES (14)..(14): Alpha-Me S5-pentenyl-alanine olefin amino acid connected by an all-carbon crosslinker comprising no double bonds
  C-term NH2
QSQQTFANLWRLLAQN

SEQ ID NO: 864 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
LTFAHYWAQLASA

SEQ ID NO: 865 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising no double bonds
  misc_feature (5)..(12): Crosslink between residues
  MOD_RES (12)..(12): Alpha-Me S5-pentenyl-alanine olefin amino acid connected by an all-carbon crosslinker comprising no double bonds
  C-term NH2
LPRFANYWRLLAQN

SEQ ID NO: 866 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising no double bonds
  misc_feature (5)..(12): Crosslink between residues
  MOD_RES (8)..(8): 6cl-Trp
  MOD_RES (12)..(12): Alpha-Me S5-pentenyl-alanine olefin amino acid connected by an all-carbon crosslinker comprising no double bonds
  C-term NH2
LPRFANYWRLLAQN

SEQ ID NO: 867 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising no double bonds
  C-term NH2
LTFAHYWAQLAS

SEQ ID NO: 868 - protein, 16 aa, Artificial Sequence
  Description of Artificial Sequence: Synthetic peptide
  N-term Ac
  MOD_RES (3)..(3): Alpha-Me S5-pentenyl-alanine olefin amino acid connected by an all-carbon crosslinker comprising no double bonds
  misc_feature (3)..(7): Crosslink between residues
  MOD_RES (7)..(7): Amino acid comprising two pentenyl-alanine olefin side chains, each of which is crosslinked to another amino acid as indicated via fully saturated hydrocarbon crosslinks
  misc_feature (7)..(14): Crosslink between residues
  MOD_RES (14)..(14): Alpha-Me R8-octenyl-alanine olefin amino acid connected by an all carbon crosslinker comprising no double bonds
  C-term NH2
QSAQTFANLWRLLAQN

SEQ ID NO: 869 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising no double bonds
  C-term NH2
LTFAHYWRQLAS

SEQ ID NO: 870 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising no double bonds
  misc_feature (7)..(14): Crosslink between residues
  MOD_RES (10)..(10): 6cl-Trp
  MOD_RES (14)..(14): Alpha-Me S5-pentenyl-alanine olefin amino acid connected by an all-carbon crosslinker comprising no double bonds
  C-term NH2
QSQQTFANLWRLLAQN

SEQ ID NO: 871 - protein, 16 aa, Artificial Sequence
  Description of Artificial Sequence: Synthetic peptide
  N-term Ac
  MOD_RES (1)..(1): Alpha-Me R8-octenyl-alanine olefin amino acid connected by an all-carbon crosslinker comprising no double bonds
  misc_feature (1)..(8): Crosslink between residues
  MOD_RES (8)..(8): Alpha-Me S5-pentenyl-alanine olefin amino acid connected by an all-carbon crosslinker comprising no double bonds
  MOD_RES (14)..(14): 2-aminoisobutyric acid
  C-term NH2
ASQQTFSALWRLLXQN

SEQ ID NO: 872 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
LTFAHYWAQLAS

SEQ ID NO: 873 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
TSFAQYWNLLAP

SEQ ID NO: 874 - protein, 12 aa, Artificial Sequence
  Description of Artificial Sequence: Synthetic peptide
  N-term Ac
  C-term NH2
LTFEHYWAQLTS

SEQ ID NO: 875 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one E configured double bond
  misc_feature (2)..(9): Crosslink between residues
  MOD_RES (5)..(5): 6cl-Trp
  MOD_RES (7)..(7): Ac3c
  MOD_RES (9)..(9): Alpha-Me S5-pentenyl-alanine olefin amino acid connected by an all-carbon crosslinker comprising one E configured double bond
  C-term NH2
FAAYWEXLA

SEQ ID NO: 876 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
AFAAAWALAAA

SEQ ID NO: 877 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWRLAAQ

SEQ ID NO: 878 - protein, 11 aa, Artificial Sequence
  Description of Artificial Sequence: Synthetic peptide
  N-term Pr
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWRLAAQ

SEQ ID NO: 879 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one E configured double bond
  misc_feature (4)..(11): Crosslink between residues
  MOD_RES (11)..(11): Alpha-Me S5-pentenyl-alanine olefin amino acid connected by an all-carbon crosslinker comprising one E configured double bond
  C-term NH2
LTFAHYWAQLAS

SEQ ID NO: 880 - protein, 23 aa, Artificial Sequence
  Description of Artificial Sequence: Synthetic peptide
  N-term Ac
  MOD_RES (7)..(7): Beta-Ala
  MOD_RES (14)..(14): Alpha-Me R8-octenyl-alanine olefin amino acid connected by an all-carbon crosslinker comprising one double bond
  misc_feature (14)..(21): Crosslink between residues
  MOD_RES (21)..(21): Alpha-Me S5-pentenyl-alanine olefin amino acid connected by an all-carbon crosslinker comprising one double bond
  C-term NH2
CCPGCCAQSQQTFANLWRLLAQN

SEQ ID NO: 881 - protein, 23 aa, Artificial Sequence
  Description of Artificial Sequence: Synthetic peptide
  N-term Ac
  MOD_RES (7)..(7): Beta-Ala
  MOD_RES (14)..(14): Alpha-Me R8-octenyl-alanine olefin amino acid connected by an all-carbon crosslinker comprising one double bond
  misc_feature (14)..(21): Crosslink between residues
  MOD_RES (21)..(21): Alpha-Me S5-pentenyl-alanine olefin amino acid connected by an all-carbon crosslinker comprising one double bond
  C-term NH2
CCPGCCAQSQQTAANLWRLLAQN

SEQ ID NO: 882 - protein, 21 aa, Artificial Sequence
  Description of Artificial Sequence: Synthetic peptide
  N-term Ac
  MOD_RES (7)..(7): Beta-Ala
  MOD_RES (8)..(8): Norleucine
  MOD_RES (12)..(12): Alpha-Me R8-octenyl-alanine olefin amino acid connected by an all-carbon crosslinker comprising one double bond
  misc_feature (12)..(19): Crosslink between residues
  MOD_RES (19)..(19): Alpha-Me S5-pentenyl-alanine olefin amino acid connected by an all-carbon crosslinker comprising one double bond
  C-term NH2
CCPGCCALPRFANYWRLLAQN

SEQ ID NO: 883 - protein, 12 aa, Artificial Sequence
  Description of Artificial Sequence: Synthetic peptide
  N-term Ac
  MOD_RES (4)..(4): Alpha-Me R8-octenyl-alanine olefin amino acid that is not connected by a crosslinker
  MOD_RES (11)..(11): Alpha-Me S5-pentenyl-alanine olefin amino acid that is not connected by a crosslinker
  C-term NH2
LTFAHYWAQLAS

SEQ ID NO: 884 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising no double bonds
  misc_feature (2)..(9): Crosslink between residues
  MOD_RES (5)..(5): 6cl-Trp
  MOD_RES (7)..(7): Ac3c
  MOD_RES (9)..(9): Alpha-Me S5-pentenyl-alanine olefin amino acid connected by an all-carbon crosslinker comprising no double bonds
  C-term NH2
FAHYWRXLA

SEQ ID NO: 885 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
QTFAHWWSQLAS

SEQ ID NO: 886 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWRQLAS

SEQ ID NO: 887 - protein, 16 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (14)..(14): 2-aminoisobutyric acid
  C-term NH2
QAQQTFSNAWRLLXQN

SEQ ID NO: 888 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (14)..(14): 2-aminoisobutyric acid
  C-term NH2
QSQQAFSNLWRALXQN

SEQ ID NO: 889 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 890 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAS

SEQ ID NO: 891 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAQ

SEQ ID NO: 892 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): 2-aminoisobutyric acid
  MOD_RES (9)..(9): Alpha-Me S5-pentenyl-alanine olefin amino acid connected by an all-carbon crosslinker comprising one double bond
  C-term NH2
FAAYWEXLAS

SEQ ID NO: 893 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAS

SEQ ID NO: 894 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEQLAS

SEQ ID NO: 895 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHYWEQLAS

SEQ ID NO: 896 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHYWAQLAS

SEQ ID NO: 897 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAHYWAXLAS

SEQ ID NO: 898 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAHYWRXLAS

SEQ ID NO: 899 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-hydrogen S5-pentenyl-alanine olefin amino acid connected by an all-carbon crosslinker comprising one double bond
  C-term NH2
FAAYWEXLAA

SEQ ID NO: 900 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising no double bonds
  misc_feature (5)..(3): Crosslink between residues
  MOD_RES (12)..(12): Alpha-Me S5-pentenyl-alanine olefin amino acid connected by an all-carbon crosslinker comprising no double bonds
  C-term NH2
LPTFANYWRLLAQN

SEQ ID NO: 901 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWRALAQ

SEQ ID NO: 902 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
TSFAHYWAQLAS

SEQ ID NO: 903 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising no double bonds
  misc_feature (2)..(9): Crosslink between residues
  MOD_RES (5)..(5): 6cl-Trp
  MOD_RES (7)..(7): Ac3c
  MOD_RES (9)..(9): Alpha-Me S5-pentenyl-alanine olefin amino acid connected by an all-carbon crosslinker comprising no double bonds
  C-term NH2
FAAYWEXLAA

SEQ ID NO: 904 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQIAS

SEQ ID NO: 905 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Norleucine
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 906 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAA

SEQ ID NO: 907 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): Abu
  C-term NH2
LTFAHYWAQLAX

SEQ ID NO: 908 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Abu
  MOD_RES (11)..(11): Alpha-Me S5-pentenyl-alanine olefin amino acid connected by an all-carbon crosslinker comprising one double bond
  C-term NH2
LTFAHYWXQLAS

SEQ ID NO: 909 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one E configured double bond
  misc_feature (4)..(11): Crosslink between residues
  MOD_RES (11)..(11): Alpha-Me S5-pentenyl-alanine olefin amino acid connected by an all-carbon crosslinker comprising one E configured double bond
  C-term NH2
LTFAAYWAQLAS

SEQ ID NO: 910 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAHYWAQLAS

SEQ ID NO: 911 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAAYWAQLAS

SEQ ID NO: 912 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one E configured double bond
  misc_feature (4)..(11): Crosslink between residues
  MOD_RES (11)..(11): Alpha-Me S5-pentenyl-alanine olefin amino acid connected by an all-carbon crosslinker comprising one E configured double bond
  C-term NH2
LTFAAYWAQLAA

SEQ ID NO: 913 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAAYWAQLAA

SEQ ID NO: 914 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFANLWALLAQ

SEQ ID NO: 915 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFANLWALLAA

SEQ ID NO: 916 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFAALWALLAQ

SEQ ID NO: 917 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LAFANLWALLAQ

SEQ ID NO: 918 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LAFAALWALLAA

SEQ ID NO: 919 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
AAAYWEXLAA

SEQ ID NO: 920 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAA

SEQ ID NO: 921 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEXLAX

SEQ ID NO: 922 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (10)..(10): Norleucine
  C-term NH2
FAAYWEXLAL

SEQ ID NO: 923 - protein, 10 aa, Artificial Sequence
  Description of Artificial Sequence: Synthetic peptide
  N-term Ac
  MOD_RES (2)..(2): Alpha-Me R5-pentenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S8-octenyl-alanine olefin amino acid connected by an all-carbon crosslinker comprising one double bond
  C-term NH2
FAAYWEXLAA

SEQ ID NO: 924 - protein, 10 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me R8-octenyl-alanine olefin amino acid connected by an all-carbon crosslinker comprising one double bond
  C-term NH2
FAAYWEXLAA

SEQ ID NO: 925 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXIAA

SEQ ID NO: 926 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Norleucine
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 927 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Alpha-Me-Leu
  MOD_RES (9)..(9): Alpha-Me S5-pentenyl-alanine olefin amino acid connected by an all-carbon crosslinker comprising one double bond
  C-term NH2
FAAYWELLAA

SEQ ID NO: 928 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Norleucine
  MOD_RES (9)..(9): Alpha-Me S5-pentenyl-alanine olefin amino acid connected by an all-carbon crosslinker comprising one double bond
  C-term NH2
FAAYWELLAA

SEQ ID NO: 929 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWQXLAA

SEQ ID NO: 930 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWAXLAA

SEQ ID NO: 931 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Abu
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWXXLAA

SEQ ID NO: 932 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Norleucine
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWLXLAA

SEQ ID NO: 933 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (3)..(3): Abu
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAXYWEXLAA

SEQ ID NO: 934 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (3)..(3): Norleucine
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FALYWEXLAA

SEQ ID NO: 935 - protein, 13 aa, Artificial Sequence
  Description of Artificial Sequence: Synthetic peptide
  N-term 5-FAM
  MOD_RES (1)..(1): Beta-Ala
  C-term NH2
ALTFEHYWAQLTS

SEQ ID NO: 936 - protein, 13 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising no double bonds
  misc_feature (5)..(12): Crosslink between residues
  MOD_RES (12)..(12): Alpha-Me S5-pentenyl-alanine olefin amino acid connected by an all-carbon crosslinker comprising no double bonds
  C-term NH2
ALTFAHYWAQLAS

SEQ ID NO: 937 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 938 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Tert-butyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 939 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Adamantyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 940 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): homo-cyclohexyl-Ala
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 941 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 942 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Ac6c
  MOD_RES (11)..(11): Alpha-Me S5-pentenyl-alanine olefin amino acid connected by an all-carbon crosslinker comprising one double bond
  C-term NH2
LTFAHYWXQLAS

SEQ ID NO: 943 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Ac5c
  MOD_RES (11)..(11): Alpha-Me S5-pentenyl-alanine olefin amino acid connected by an all-carbon crosslinker comprising one double bond
  C-term NH2
LTFAHYWXQLAS

SEQ ID NO: 944 - protein, 12 aa, Artificial Sequence
  Description of Artificial Sequence: Synthetic peptide
  N-term Ac
  MOD_RES (3)..(3): homo-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 945 - protein, 12 aa, Artificial Sequence
  Description of Artificial Sequence: Synthetic peptide
  N-term Ac
  MOD_RES (3)..(3): Indanyl-Gly
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTGAHYWAQLAS

SEQ ID NO: 946 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 947 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQFAS

SEQ ID NO: 948 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Indanyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 949 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 950 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclopentyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 951 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): hY
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 952 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): hLeu
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 953 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Tert-butyl-Gly
  MOD_RES (9)..(9): Alpha-Me S5-pentenyl-alanine olefin amino acid connected by an all-carbon crosslinker comprising one double bond
  C-term NH2
FAAYWEXGAA

SEQ ID NO: 954 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Adamantyl-Gly
  MOD_RES (9)..(9): Alpha-Me S5-pentenyl-alanine olefin amino acid connected by an all-carbon crosslinker comprising one double bond
  C-term NH2
FAAYWEXGAA

SEQ ID NO: 955 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): homo-cyclohexyl-Ala
  MOD_RES (9)..(9): Alpha-Me S5-pentenyl-alanine olefin amino acid connected by an all-carbon crosslinker comprising one double bond
  C-term NH2
FAAYWEXAAA

SEQ ID NO: 956 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Cyclohexyl-Ala
  MOD_RES (9)..(9): Alpha-Me S5-pentenyl-alanine olefin amino acid connected by an all-carbon crosslinker comprising one double bond
  C-term NH2
FAAYWEXAAA

SEQ ID NO: 957 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac6c
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 958 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac5c
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 959 - protein, 10 aa, Artificial Sequence
  Description of Artificial Sequence: Synthetic peptide
  N-term Ac
  MOD_RES (1)..(1): homo-Phe
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 960 - protein, 10 aa, Artificial Sequence
  Description of Artificial Sequence: Synthetic peptide
  N-term Ac
  MOD_RES (1)..(1): Indanyl-Gly
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
GAAYWEXLAA

SEQ ID NO: 961 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXFAA

SEQ ID NO: 962 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Indanyl-Gly
  MOD_RES (9)..(9): Alpha-Me S5-pentenyl-alanine olefin amino acid connected by an all-carbon crosslinker comprising one double bond
  C-term NH2
FAAYWEXGAA

SEQ ID NO: 963 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Cyclobutyl-Ala
  MOD_RES (9)..(9): Alpha-Me S5-pentenyl-alanine olefin amino acid connected by an all-carbon crosslinker comprising one double bond
  C-term NH2
FAAYWEXAAA

SEQ ID NO: 964 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Cyclopentyl-Gly
  MOD_RES (9)..(9): Alpha-Me S5-pentenyl-alanine olefin amino acid connected by an all-carbon crosslinker comprising one double bond
  C-term NH2
FAAYWEXGAA

SEQ ID NO: 965 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (4)..(4): hY
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 966 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAQ

SEQ ID NO: 967 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): 2-aminoisobutyric acid
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 968 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 969 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAAYWAALAA

SEQ ID NO: 970 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Ac3c
  MOD_RES (11)..(11): Alpha-Me S5-pentenyl-alanine olefin amino acid connected by an all-carbon crosslinker comprising one double bond
  C-term NH2
LTFAHYWAXLAS

SEQ ID NO: 971 - protein, 12 aa, Artificial Sequence
  Description of Artificial Sequence: Synthetic peptide
  N-term Ac
  MOD_RES (1)..(1): Norleucine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 972 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
VTFAHYWAQLAS

SEQ ID NO: 973 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAHYWAQLAS

SEQ ID NO: 974 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAHYWAQLAS

SEQ ID NO: 975 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
RTFAHYWAQLAS

SEQ ID NO: 976 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
KTFAHYWAQLAS

SEQ ID NO: 977 - protein, 12 aa, Artificial Sequence
  Description of Artificial Sequence: Synthetic peptide
  N-term Ac
  MOD_RES (2)..(2): Norleucine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LLFAHYWAQLAS

SEQ ID NO: 978 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LVFAHYWAQLAS

SEQ ID NO: 979 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LFFAHYWAQLAS

SEQ ID NO: 980 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LWFAHYWAQLAS

SEQ ID NO: 981 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LRFAHYWAQLAS

SEQ ID NO: 982 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LKFAHYWAQLAS

SEQ ID NO: 983 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Norleucine
  MOD_RES (11)..(11): Alpha-Me S5-pentenyl-alanine olefin amino acid connected by an all-carbon crosslinker comprising one double bond
  C-term NH2
LTFALYWAQLAS

SEQ ID NO: 984 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLAS

SEQ ID NO: 985 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAFYWAQLAS

SEQ ID NO: 986 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAWYWAQLAS

SEQ ID NO: 987 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFARYWAQLAS

SEQ ID NO: 988 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAKYWAQLAS

SEQ ID NO: 989 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Norleucine
  MOD_RES (11)..(11): Alpha-Me S5-pentenyl-alanine olefin amino acid connected by an all-carbon crosslinker comprising one double bond
  C-term NH2
LTFAHLWAQLAS

SEQ ID NO: 990 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHVWAQLAS

SEQ ID NO: 991 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 992 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHWWAQLAS

SEQ ID NO: 993 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHRWAQLAS

SEQ ID NO: 994 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHKWAQLAS

SEQ ID NO: 995 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Norleucine
  MOD_RES (11)..(11): Alpha-Me S5-pentenyl-alanine olefin amino acid connected by an all-carbon crosslinker comprising one double bond
  C-term NH2
LTFAHYWLQLAS

SEQ ID NO: 996 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWVQLAS

SEQ ID NO: 997 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWFQLAS

SEQ ID NO: 998 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWWQLAS

SEQ ID NO: 999 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWKQLAS

SEQ ID NO: 1000 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFAHYWALLAS

SEQ ID NO: 1001 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAVLAS

SEQ ID NO: 1002 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAFLAS

SEQ ID NO: 1003 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAWLAS

SEQ ID NO: 1004 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWARLAS

SEQ ID NO: 1005 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): Norleucine
  C-term NH2
LTFAHYWAQLAL

SEQ ID NO: 1006 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAV

SEQ ID NO: 1007 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAF

SEQ ID NO: 1008 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAW

SEQ ID NO: 1009 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAR

SEQ ID NO: 1010 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAK

SEQ ID NO: 1011 - protein, 16 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (14)..(14): 2-aminoisobutyric acid
  C-term NH2
QAQQTFSNAWRLLXQN

SEQ ID NO: 1012 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (14)..(14): 2-aminoisobutyric acid
  C-term NH2
QSQQAFSNLWRALXQN

SEQ ID NO: 1013 - protein, 12 aa, Artificial Sequence
  Description of Artificial Sequence: Synthetic peptide
  N-term Ac
  MOD_RES (3)..(3): 2Pal
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWAQLAS

SEQ ID NO: 1014 - protein, 12 aa, Artificial Sequence
  Description of Artificial Sequence: Synthetic peptide
  N-term Ac
  MOD_RES (3)..(3): 3Pal
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWAQLAS

SEQ ID NO: 1015 - protein, 12 aa, Artificial Sequence
  Description of Artificial Sequence: Synthetic peptide
  N-term Ac
  MOD_RES (3)..(3): 4Pal
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWAQLAS

SEQ ID NO: 1016 - protein, 12 aa, Artificial Sequence
  Description of Artificial Sequence: Synthetic peptide
  N-term Ac
  MOD_RES (3)..(3): Phe-2CF3
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1017 - protein, 12 aa, Artificial Sequence
  Description of Artificial Sequence: Synthetic peptide
  N-term Ac
  MOD_RES (3)..(3): Phe-2CN
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1018 - protein, 12 aa, Artificial Sequence
  Description of Artificial Sequence: Synthetic peptide
  N-term Ac
  MOD_RES (3)..(3): Phe-2Me
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1019 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1020 - protein, 12 aa, Artificial Sequence
  Description of Artificial Sequence: Synthetic peptide
  N-term Ac
  MOD_RES (3)..(3): D-Phe-4CF3
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1021 - protein, 12 aa, Artificial Sequence
  Description of Artificial Sequence: Synthetic peptide
  N-term Ac
  MOD_RES (3)..(3): Phe-4tBu
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1022 - protein, 12 aa, Artificial Sequence
  Description of Artificial Sequence: Synthetic peptide
  N-term Ac
  MOD_RES (3)..(3): Phe-5F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1023 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(12): Crosslink between residues
  MOD_RES (7)..(7): 3Bth
  MOD_RES (12)..(12): Alpha-Me S5-pentenyl-alanine olefin amino acid connected by an all-carbon crosslinker comprising one double bond
  C-term NH2
LTFAHYXAAQLAS

SEQ ID NO: 1024 - protein, 12 aa, Artificial Sequence
  Description of Artificial Sequence: Synthetic peptide
  N-term Ac
  MOD_RES (3)..(3): Phe-2Br
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1025 - protein, 12 aa, Artificial Sequence
  Description of Artificial Sequence: Synthetic peptide
  N-term Ac
  MOD_RES (3)..(3): Phe-4Br
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1026 - protein, 12 aa, Artificial Sequence
  Description of Artificial Sequence: Synthetic peptide
  N-term Ac
  MOD_RES (3)..(3): Phe-2Cl
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1027 - protein, 12 aa, Artificial Sequence
  Description of Artificial Sequence: Synthetic peptide
  N-term Ac
  MOD_RES (3)..(3): Phe-4Cl
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1028 - protein, 12 aa, Artificial Sequence
  Description of Artificial Sequence: Synthetic peptide
  N-term Ac
  MOD_RES (3)..(3): Phe-3CN
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1029 - protein, 12 aa, Artificial Sequence
  Description of Artificial Sequence: Synthetic peptide
  N-term Ac
  MOD_RES (3)..(3): Phe-4CN
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1030 - protein, 12 aa, Artificial Sequence
  Description of Artificial Sequence: Synthetic peptide
  N-term Ac
  MOD_RES (3)..(3): Phe-34Cl2
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1031 - protein, 12 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1032 - protein, 12 aa, Artificial Sequence
  Description of Artificial Sequence: Synthetic peptide
  N-term Ac
  MOD_RES (3)..(3): 3,5-difluoro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1033 - protein, 12 aa, Artificial Sequence
  Description of Artificial Sequence: Synthetic peptide
  N-term Ac
  MOD_RES (3)..(3): 3,3-di-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1034 - protein, 12 aa, Artificial Sequence
  Description of Artificial Sequence: Synthetic peptide
  N-term Ac
  MOD_RES (3)..(3): 2-Fluoro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1035 - protein, 12 aa, Artificial Sequence
  Description of Artificial Sequence: Synthetic peptide
  N-term Ac
  MOD_RES (3)..(3): 3-fluoro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1036 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1037 - protein, 12 aa, Artificial Sequence
  Description of Artificial Sequence: Synthetic peptide
  N-term Ac
  MOD_RES (3)..(3): 4-iodo-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1038 - protein, 12 aa, Artificial Sequence
  Description of Artificial Sequence: Synthetic peptide
  N-term Ac
  MOD_RES (3)..(3): Phe-3Me
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1039 - protein, 12 aa, Artificial Sequence
  Description of Artificial Sequence: Synthetic peptide
  N-term Ac
  MOD_RES (3)..(3): Phe-4Me
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1040 - protein, 12 aa, Artificial Sequence
  Description of Artificial Sequence: Synthetic peptide
  N-term Ac
  MOD_RES (3)..(3): 1-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWAQLAS

SEQ ID NO: 1041 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWAQLAS

SEQ ID NO: 1042 - protein, 12 aa, Artificial Sequence
  Description of Artificial Sequence: Synthetic peptide
  N-term Ac
  MOD_RES (3)..(3): Phe-3CF3
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1043 - protein, 12 aa, Artificial Sequence
  Description of Artificial Sequence: Synthetic peptide
  N-term Ac
  MOD_RES (3)..(3): Phe-4NO2
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1044 - protein, 12 aa, Artificial Sequence
  Description of Artificial Sequence: Synthetic peptide
  N-term Ac
  MOD_RES (3)..(3): Phe-3NO2
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1045 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): 2Thi
  MOD_RES (11)..(11): Alpha-Me S5-pentenyl-alanine olefin amino acid connected by an all-carbon crosslinker comprising one double bond
  C-term NH2
LTFAXYWAQLAS

SEQ ID NO: 1046 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Bi-Phe
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1047 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4tBu
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1048 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): D-Phe-4CF3
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1049 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4Cl
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1050 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4Me
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1051 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4Br
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1052 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4CN
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1053 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4NO2
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1054 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 1-Naphthalanine
  MOD_RES (11)..(11): Alpha-Me S5-pentenyl-alanine olefin amino acid connected by an all-carbon crosslinker comprising one double bond
  C-term NH2
LTFAHAWAQLAS

SEQ ID NO: 1055 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 2-Naphthalanine
  MOD_RES (11)..(11): Alpha-Me S5-pentenyl-alanine olefin amino acid connected by an all-carbon crosslinker comprising one double bond
  C-term NH2
LTFAHAWAQLAS

SEQ ID NO: 1056 - protein, 11 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(10): Crosslink between residues
  MOD_RES (10)..(10): Alpha-Me S5-pentenyl-alanine olefin amino acid connected by an all-carbon crosslinker comprising one double bond
  C-term NH2
LTFAHWAQLAS

SEQ ID NO: 1057 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 1-Naphthalanine
  MOD_RES (11)..(11): Alpha-Me S5-pentenyl-alanine olefin amino acid connected by an all-carbon crosslinker comprising one double bond
  C-term NH2
LTFAHYAAQLAS

SEQ ID NO: 1058 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 2-Naphthalanine
  MOD_RES (11)..(11): Alpha-Me S5-pentenyl-alanine olefin amino acid connected by an all-carbon crosslinker comprising one double bond
  C-term NH2
LTFAHYAAQLAS

SEQ ID NO: 1059 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQIAS

SEQ ID NO: 1060 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Norleucine
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1061 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one E configured double bond
  misc_feature (4)..(11): Crosslink between residues
  MOD_RES (11)..(11): Alpha-Me S5-pentenyl-alanine olefin amino acid connected by an all-carbon crosslinker comprising one E configured double bond
  C-term NH2
LTFAHYWAQLAA

SEQ ID NO: 1062 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): Abu
  C-term NH2
LTFAHYWAQLAX

SEQ ID NO: 1063 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Abu
  MOD_RES (11)..(11): Alpha-Me S5-pentenyl-alanine olefin amino acid connected by an all-carbon crosslinker comprising one double bond
  C-term NH2
LTFAHYWXQLAS

SEQ ID NO: 1064 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAHYWAQLAS

SEQ ID NO: 1065 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFANLWALLAQ

SEQ ID NO: 1066 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFAALWALLAQ

SEQ ID NO: 1067 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LAFANLWALLAQ

SEQ ID NO: 1068 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWAXLAA

SEQ ID NO: 1069 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAALAS

SEQ ID NO: 1070 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LVFAAYWAQLAS

SEQ ID NO: 1071 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Abu
  MOD_RES (11)..(11): Alpha-Me S5-pentenyl-alanine olefin amino acid connected by an all-carbon crosslinker comprising one double bond
  C-term NH2
LTFAAYWXQLAS

SEQ ID NO: 1072 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Norleucine
  MOD_RES (11)..(11): Alpha-Me S5-pentenyl-alanine olefin amino acid connected by an all-carbon crosslinker comprising one double bond
  C-term NH2
LTFAAYWLQLAS

SEQ ID NO: 1073 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Abu
  MOD_RES (11)..(11): Alpha-Me S5-pentenyl-alanine olefin amino acid connected by an all-carbon crosslinker comprising one double bond
  C-term NH2
LTFAXYWAQLAS

SEQ ID NO: 1074 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWHQLAS

SEQ ID NO: 1075 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWKQLAS

SEQ ID NO: 1076 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Ornithine
  MOD_RES (11)..(11): Alpha-Me S5-pentenyl-alanine olefin amino acid connected by an all-carbon crosslinker comprising one double bond
  C-term NH2
LTFAAYWXQLAS

SEQ ID NO: 1077 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWRQLAS

SEQ ID NO: 1078 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWSQLAS

SEQ ID NO: 1079 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWRALAS

SEQ ID NO: 1080 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWRQLAA

SEQ ID NO: 1081 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWRALAA

SEQ ID NO: 1082 - protein, 12 aa, Artificial Sequence
  Description of Artificial Sequence: Synthetic peptide
  N-term Ac
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (11)..(11): Alpha-Me S8-octenyl-alanine olefin amino acid connected by an all-carbon crosslinker comprising one double bond
  C-term NH2
LTFAHYWAQLAS

SEQ ID NO: 1083 - protein, 12 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  misc_feature (4)..(11): Crosslink between residues
  MOD_RES (11)..(11): Alpha-Me R8-octenyl-alanine olefin amino acid connected by an all-carbon crosslinker comprising one double bond
  C-term NH2
LTFAHYWAQLAS

SEQ ID NO: 1084 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAALAS

SEQ ID NO: 1085 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Abu
  MOD_RES (11)..(11): Alpha-Me S5-pentenyl-alanine olefin amino acid connected by an all-carbon crosslinker comprising one double bond
  C-term NH2
LTFAHYWAXLAS

SEQ ID NO: 1086 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWALLAS

SEQ ID NO: 1087 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWHALAA

SEQ ID NO: 1088 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAALAA

SEQ ID NO: 1089 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWSALAA

SEQ ID NO: 1090 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWRALAA

SEQ ID NO: 1091 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWKALAA

SEQ ID NO: 1092 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Ornithine
  MOD_RES (9)..(9): Alpha-Me S5-pentenyl-alanine olefin amino acid connected by an all-carbon crosslinker comprising one double bond
  C-term NH2
FAAYWXALAA

SEQ ID NO: 1093 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAVYWEXLAA

SEQ ID NO: 1094 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAFYWEXLAA

SEQ ID NO: 1095 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAWYWEXLAA

SEQ ID NO: 1096 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FARYWEXLAA

SEQ ID NO: 1097 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAKYWEXLAA

SEQ ID NO: 1098 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (4)..(4): Norleucine
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAALWEXLAA

SEQ ID NO: 1099 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAVWEXLAA

SEQ ID NO: 1100 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAFWEXLAA

SEQ ID NO: 1101 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAWWEXLAA

SEQ ID NO: 1102 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAARWEXLAA

SEQ ID NO: 1103 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAKWEXLAA

SEQ ID NO: 1104 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWVXLAA

SEQ ID NO: 1105 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWFXLAA

SEQ ID NO: 1106 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWWXLAA

SEQ ID NO: 1107 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWRXLAA

SEQ ID NO: 1108 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWKXLAA

SEQ ID NO: 1109 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEVLAA

SEQ ID NO: 1110 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEFLAA

SEQ ID NO: 1111 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEWLAA

SEQ ID NO: 1112 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWERLAA

SEQ ID NO: 1113 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEKLAA

SEQ ID NO: 1114 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAV

SEQ ID NO: 1115 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAF

SEQ ID NO: 1116 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAW

SEQ ID NO: 1117 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAR

SEQ ID NO: 1118 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAK

SEQ ID NO: 1119 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAV

SEQ ID NO: 1120 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAF

SEQ ID NO: 1121 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAW

SEQ ID NO: 1122 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAR

SEQ ID NO: 1123 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAK

SEQ ID NO: 1124 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAH

SEQ ID NO: 1125 - protein, 12 aa, Artificial Sequence
  Description of Artificial Sequence: Synthetic peptide
  N-term Ac
  MOD_RES (3)..(3): Phe-2NO2
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1126 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYAAQLAS

SEQ ID NO: 1127 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYAAQLAS

SEQ ID NO: 1128 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWALLAAN

SEQ ID NO: 1129 - protein, 16 aa, Artificial Sequence
  Description of Artificial Sequence: Synthetic peptide
  N-term Ac
  MOD_RES (2)..(2): 2-aminoisobutyric acid
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QXQQTFANLWALLAAN

SEQ ID NO: 1130 - protein, 16 aa, Artificial Sequence
  Description of Artificial Sequence: Synthetic peptide
  N-term Ac
  MOD_RES (2)..(2): 2-aminoisobutyric acid
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QXQQTFAALWALLAAN

SEQ ID NO: 1131 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
AAAATFAAAWAALAAA

SEQ ID NO: 1132 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAAWRALAQ

SEQ ID NO: 1133 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWAALAQ

SEQ ID NO: 1134 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWRALAA

SEQ ID NO: 1135 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
VFAAAWRALAQ

SEQ ID NO: 1136 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
AFAAAWAALAA

SEQ ID NO: 1137 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWKALAQ

SEQ ID NO: 1138 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (7)..(7): Ornithine
  MOD_RES (10)..(10): Alpha-Me S5-pentenyl-alanine olefin amino acid connected by an all-carbon crosslinker comprising one double bond
  C-term NH2
TFAAAWXALAQ

SEQ ID NO: 1139 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWSALAQ

SEQ ID NO: 1140 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAAWRALAQ

SEQ ID NO: 1141 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAQLAA

SEQ ID NO: 1142 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAWWAALAA

SEQ ID NO: 1143 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAWWAQLAA

SEQ ID NO: 1144 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALA

SEQ ID NO: 1145 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAALA

SEQ ID NO: 1146 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWKALA

SEQ ID NO: 1147 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Ornithine
  MOD_RES (9)..(9): Alpha-Me S5-pentenyl-alanine olefin amino acid connected by an all-carbon crosslinker comprising one double bond
  C-term NH2
FAAYWXALA

SEQ ID NO: 1148 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWQALA

SEQ ID NO: 1149 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAQLA

SEQ ID NO: 1150 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHYWDQLAS

SEQ ID NO: 1151 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHFWEQLAS

SEQ ID NO: 1152 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWHQLAS

SEQ ID NO: 1153 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWKQLAS

SEQ ID NO: 1154 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Ornithine
  MOD_RES (9)..(9): Alpha-Me S5-pentenyl-alanine olefin amino acid connected by an all-carbon crosslinker comprising one double bond
  C-term NH2
FAAYWXQLAS

SEQ ID NO: 1155 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHYWSQLAS

SEQ ID NO: 1156 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHWWEQLAS

SEQ ID NO: 1157 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHWWAQLAS

SEQ ID NO: 1158 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAWWHQLAS

SEQ ID NO: 1159 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAWWKQLAS

SEQ ID NO: 1160 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Ornithine
  MOD_RES (9)..(9): Alpha-Me S5-pentenyl-alanine olefin amino acid connected by an all-carbon crosslinker comprising one double bond
  C-term NH2
FAAWWXQLAS

SEQ ID NO: 1161 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHWWSQLAS

SEQ ID NO: 1162 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFANYWALLAQ

SEQ ID NO: 1163 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFANLWAQLAQ

SEQ ID NO: 1164 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFANYWALLAA

SEQ ID NO: 1165 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFANLWAQLAA

SEQ ID NO: 1166 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFAAYWALLAQ

SEQ ID NO: 1167 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAALWAQLAQ

SEQ ID NO: 1168 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LAFANYWALLAQ

SEQ ID NO: 1169 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFANLWAQLAQ

SEQ ID NO: 1170 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LAFAAYWALLAA

SEQ ID NO: 1171 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAALWAQLAA

SEQ ID NO: 1172 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAAYWAALAA

SEQ ID NO: 1173 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (11)..(11): 2-aminoisobutyric acid
  C-term NH2
FAAYWEXLAAX

SEQ ID NO: 1174 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAQLAAA

SEQ ID NO: 1175 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWAXLAAA

SEQ ID NO: 1176 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWSXLAAA

SEQ ID NO: 1177 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAS

SEQ ID NO: 1178 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAT

SEQ ID NO: 1179 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAL

SEQ ID NO: 1180 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAQ

SEQ ID NO: 1181 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAFWEXLAAA

SEQ ID NO: 1182 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAWWEXLAAA

SEQ ID NO: 1183 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLASA

SEQ ID NO: 1184 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAAA

SEQ ID NO: 1185 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Norleucine
  MOD_RES (9)..(9): Alpha-Me S5-pentenyl-alanine olefin amino acid connected by an all-carbon crosslinker comprising one double bond
  C-term NH2
FAAYWELLAAA

SEQ ID NO: 1186 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEXLAXA

SEQ ID NO: 1187 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (10)..(10): Norleucine
  C-term NH2
FAAYWEXLALA

SEQ ID NO: 1188 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): 2-aminoisobutyric acid
  MOD_RES (9)..(9): Alpha-Me S5-pentenyl-alanine olefin amino acid connected by an all-carbon crosslinker comprising one double bond
  MOD_RES (10)..(10): Norleucine
  C-term NH2
FAAYWEXLALA

SEQ ID NO: 1189 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (10)..(10): Norleucine
  C-term NH2
FAAYWEALALA

SEQ ID NO: 1190 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Norleucine
  MOD_RES (9)..(9): Alpha-Me S5-pentenyl-alanine olefin amino acid connected by an all-carbon crosslinker comprising one double bond
  MOD_RES (10)..(10): Norleucine
  C-term NH2
FAAYWELLALA

SEQ ID NO: 1191 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): 2-aminoisobutyric acid
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEXLAX

SEQ ID NO: 1192 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Norleucine
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWELLAX

SEQ ID NO: 1193 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEALAX

SEQ ID NO: 1194 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAFWAQLAS

SEQ ID NO: 1195 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAWWAQLAS

SEQ ID NO: 1196 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQIAS

SEQ ID NO: 1197 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Norleucine
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1198 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASA

SEQ ID NO: 1199 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAWWAQLAA

SEQ ID NO: 1200 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQIAA

SEQ ID NO: 1201 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Norleucine
  MOD_RES (11)..(11): Alpha-Me S5-pentenyl-alanine olefin amino acid connected by an all-carbon crosslinker comprising one double bond
  C-term NH2
LTFAAYWAQLAA

SEQ ID NO: 1202 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAA

SEQ ID NO: 1203 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHWWAQLAS

SEQ ID NO: 1204 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHRWAQLAS

SEQ ID NO: 1205 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHKWAQLAS

SEQ ID NO: 1206 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAW

SEQ ID NO: 1207 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Abu
  MOD_RES (9)..(9): Alpha-Me S5-pentenyl-alanine olefin amino acid connected by an all-carbon crosslinker comprising one double bond
  C-term NH2
FAAYWXALAA

SEQ ID NO: 1208 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (3)..(3): Abu
  MOD_RES (9)..(9): Alpha-Me S5-pentenyl-alanine olefin amino acid connected by an all-carbon crosslinker comprising one double bond
  C-term NH2
FAXYWEALAA

SEQ ID NO: 1209 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising no double bonds
  misc_feature (5)..(12): Crosslink between residues
  MOD_RES (12)..(12): Alpha-Me S5-pentenyl-alanine olefin amino acid connected by an all-carbon crosslinker comprising no double bonds
  C-term NH2
LPRFANYWRLLAQN

SEQ ID NO: 1210 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
TSFAHYWAQLAS

SEQ ID NO: 1211 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
LTFAAYWAQLAS

SEQ ID NO: 1212 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
HTFAHYWAQLAS

SEQ ID NO: 1213 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LHFAHYWAQLAS

SEQ ID NO: 1214 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHHWAQLAS

SEQ ID NO: 1215 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWHQLAS

SEQ ID NO: 1216 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAHLAS

SEQ ID NO: 1217 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAH

SEQ ID NO: 1218 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHPr
LTFAHYWAQLAS

SEQ ID NO: 1219 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHsBu
LTFAHYWAQLAS

SEQ ID NO: 1220 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHiBu
LTFAHYWAQLAS

SEQ ID NO: 1221 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHBn
LTFAHYWAQLAS

SEQ ID NO: 1222 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHPe
LTFAHYWAQLAS

SEQ ID NO: 1223 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHChx
LTFAHYWAQLAS

SEQ ID NO: 1224 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAAYWAQLAS

SEQ ID NO: 1225 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
STFAAYWAQLAS

SEQ ID NO: 1226 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LEFAAYWAQLAS

SEQ ID NO: 1227 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LSFAAYWAQLAS

SEQ ID NO: 1228 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAS

SEQ ID NO: 1229 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFASYWAQLAS

SEQ ID NO: 1230 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWEQLAS

SEQ ID NO: 1231 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAELAS

SEQ ID NO: 1232 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWASLAS

SEQ ID NO: 1233 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAE

SEQ ID NO: 1234 - protein, 12 aa, Artificial Sequence
  Description of Artificial Sequence: Synthetic peptide
  N-term Ac
  MOD_RES (3)..(3): Phe-2CN
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1235 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1236 - protein, 12 aa, Artificial Sequence
  Description of Artificial Sequence: Synthetic peptide
  N-term Ac
  MOD_RES (3)..(3): 3,3-di-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTXAHYWAQLAS

SEQ ID NO: 1237 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Tert-butyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 1238 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1239 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl6br-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1240 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl6f-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1241 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl4m-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1242 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl5cl-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1243 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl7m-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1244 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
LTFAHYWAQLAA

SEQ ID NO: 1245 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Cou
  MOD_RES (11)..(11): Alpha-Me S5-pentenyl-alanine olefin amino acid connected by an all-carbon crosslinker comprising one double bond
  C-term NH2
LTFAHXWAQLAS

SEQ ID NO: 1246 - protein, 12 aa, Artificial Sequence
  Description of Artificial Sequence: Synthetic peptide
  N-term Ac
  MOD_RES (6)..(6): Cou
  C-term NH2
LTFEHXWAQLTS

SEQ ID NO: 1247 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Cou
  MOD_RES (11)..(11): Alpha-Me S5-pentenyl-alanine olefin amino acid connected by an all-carbon crosslinker comprising one double bond
  C-term NH2
LTAAHXWAQLAS

SEQ ID NO: 1248 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEALAXA

SEQ ID NO: 1249 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEAIAAA

SEQ ID NO: 1250 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (8)..(8): Norleucine
  MOD_RES (9)..(9): Alpha-Me S5-pentenyl-alanine olefin amino acid connected by an all-carbon crosslinker comprising one double bond
  C-term NH2
FAAYWEALAAA

SEQ ID NO: 1251 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Alpha-Me-Leu
  MOD_RES (9)..(9): Alpha-Me S5-pentenyl-alanine olefin amino acid connected by an all-carbon crosslinker comprising one double bond
  C-term NH2
FAAYWELLAAA

SEQ ID NO: 1252 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWQALAAA

SEQ ID NO: 1253 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAALAAA

SEQ ID NO: 1254 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Abu
  MOD_RES (9)..(9): Alpha-Me S5-pentenyl-alanine olefin amino acid connected by an all-carbon crosslinker comprising one double bond
  C-term NH2
FAAYWXALAAA

SEQ ID NO: 1255 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Norleucine
  MOD_RES (9)..(9): Alpha-Me S5-pentenyl-alanine olefin amino acid connected by an all-carbon crosslinker comprising one double bond
  C-term NH2
FAAYWLALAAA

SEQ ID NO: 1256 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (3)..(3): Abu
  MOD_RES (9)..(9): Alpha-Me S5-pentenyl-alanine olefin amino acid connected by an all-carbon crosslinker comprising one double bond
  C-term NH2
FAXYWEALAAA

SEQ ID NO: 1257 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (3)..(3): Norleucine
  MOD_RES (9)..(9): Alpha-Me S5-pentenyl-alanine olefin amino acid connected by an all-carbon crosslinker comprising one double bond
  C-term NH2
FALYWEALAAA

SEQ ID NO: 1258 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAFYWEALAAA

SEQ ID NO: 1259 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1260 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Adamantyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 1261 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Indanyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 1262 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAQLAAA

SEQ ID NO: 1263 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAALWAQLAQ

SEQ ID NO: 1264 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAAA

SEQ ID NO: 1265 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Norleucine
  MOD_RES (9)..(9): Alpha-Me S5-pentenyl-alanine olefin amino acid connected by an all-carbon crosslinker comprising one double bond
  C-term NH2
FAAYWELLAAA

SEQ ID NO: 1266 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): 2-aminoisobutyric acid
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEXLAX

SEQ ID NO: 1267 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Norleucine
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWELLAX

SEQ ID NO: 1268 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEALAX

SEQ ID NO: 1269 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEXLAXA

SEQ ID NO: 1270 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (10)..(10): Norleucine
  C-term NH2
FAAYWEXLALA

SEQ ID NO: 1271 - protein, 12 aa, Artificial Sequence
  Description of Artificial Sequence: Synthetic peptide
  N-term H
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1272 - protein, 12 aa, Artificial Sequence
  Description of Artificial Sequence: Synthetic peptide
  N-term mdPEG3
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1273 - protein, 12 aa, Artificial Sequence
  Description of Artificial Sequence: Synthetic peptide
  N-term mdPEG7
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1274 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (4)..(4): Pmp
  MOD_RES (5)..(5): Et6cl-Trp
  MOD_RES (9)..(9): Alpha-Me S5-pentenyl-alanine olefin amino acid connected by an all-carbon crosslinker comprising one double bond
  C-term NH2
FAAXWEALAA

SEQ ID NO: 1275 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1276 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAA

SEQ ID NO: 1277 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWWQLAS

SEQ ID NO: 1278 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWWQLAS

SEQ ID NO: 1279 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWWQLAS

SEQ ID NO: 1280 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWWQLAA

SEQ ID NO: 1281 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWWQLAA

SEQ ID NO: 1282 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1283 - protein, 12 aa, Artificial Sequence
  Description of Artificial Sequence: Synthetic peptide
  N-term Ac
  MOD_RES (3)..(3): 2-Fluoro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1284 - protein, 12 aa, Artificial Sequence
  Description of Artificial Sequence: Synthetic peptide
  N-term Ac
  MOD_RES (3)..(3): 3-fluoro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1285 - protein, 12 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1286 - protein, 12 aa, Artificial Sequence
  Description of Artificial Sequence: Synthetic peptide
  N-term Ac
  MOD_RES (3)..(3): 3,5-difluoro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1287 - protein, 10 aa, Artificial Sequence
  Description of Artificial Sequence: Synthetic peptide
  N-term Ac
  MOD_RES (1)..(1): 3-Chloro-Phe
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1288 - protein, 11 aa, Artificial Sequence
  Description of Artificial Sequence: Synthetic peptide
  N-term Ac
  MOD_RES (1)..(1): 3-Chloro-Phe
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAAA

SEQ ID NO: 1289 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (9)..(9): Alpha-Me S5-pentenyl-alanine olefin amino acid connected by an all-carbon crosslinker comprising one double bond
  C-term NH2
FAAYWEALAAA

SEQ ID NO: 1290 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (9)..(9): Alpha-Me S5-pentenyl-alanine olefin amino acid connected by an all-carbon crosslinker comprising one double bond
  C-term NH2
FAAYWEALA

SEQ ID NO: 1291 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  MOD_RES (11)..(11): Amino acid comprising two pentenyl-alanine olefin side chains that are not crosslinked
  C-term NH2
LTFAHYWAQLAS

SEQ ID NO: 1292 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHsBu
LTFAHYWAQLAS

SEQ ID NO: 1293 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
STFAAYWAQLAS

SEQ ID NO: 1294 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAELAS

SEQ ID NO: 1295 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAE

SEQ ID NO: 1296 - protein, 12 aa, Artificial Sequence
  Description of Artificial Sequence: Synthetic peptide
  N-term mdPEG3
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1297 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1298 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1299 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAAYWAQGAS

SEQ ID NO: 1300 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1301 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1302 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1303 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 1304 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 1305 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 1306 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1307 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1308 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAAYWAQGAS

SEQ ID NO: 1309 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1310 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1311 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1312 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAAYWAQGAS

SEQ ID NO: 1313 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1314 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): homo-Phe
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1315 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Phe-3CF3
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1316 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Phe-3Me
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1317 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): 1-Naphthalanine
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1318 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Bi-Phe
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1319 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAFYWAQLAA

SEQ ID NO: 1320 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHAm
LTFAHYWAQLAS

SEQ ID NO: 1321 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHiAm
LTFAHYWAQLAS

SEQ ID NO: 1322 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnPr3Ph
LTFAHYWAQLAS

SEQ ID NO: 1323 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnBu3,3Me
LTFAHYWAQLAS

SEQ ID NO: 1324 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnPr
LTFAHYWAQLAS

SEQ ID NO: 1325 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnEt2Ch
LTFAHYWAQLAS

SEQ ID NO: 1326 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHHex
LTFAHYWAQLAS

SEQ ID NO: 1327 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHmdPeg2
LTFAAYWAQLAS

SEQ ID NO: 1328 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHmdPeg2
LTFAAYWAQLAA

SEQ ID NO: 1329 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHmdPeg4
LTFAAYWAQLAA

SEQ ID NO: 1330 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl4m-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1331 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl5cl-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1332 - protein, 12 aa, Artificial Sequence
  Description of Artificial Sequence: Synthetic peptide
  N-term Ac
  MOD_RES (3)..(3): homo-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1333 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAAYWAQLAS

SEQ ID NO: 1334 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAAYWAQLAS

SEQ ID NO: 1335 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWVQLAS

SEQ ID NO: 1336 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAALAA

SEQ ID NO: 1337 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLAA

SEQ ID NO: 1338 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAIYWAQLAS

SEQ ID NO: 1339 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAVYWSQLAS

SEQ ID NO: 1340 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFYWAQLAS

SEQ ID NO: 1341 - protein, 12 aa, Artificial Sequence
  Description of Artificial Sequence: Synthetic peptide
  N-term Ac
  MOD_RES (1)..(1): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ATFAVYWSQLAS

SEQ ID NO: 1342 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFALYWSQLAS

SEQ ID NO: 1343 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAFYWAQLAS

SEQ ID NO: 1344 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAVYWAQLAS

SEQ ID NO: 1345 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAWYWAQLAS

SEQ ID NO: 1346 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
VTFAAYWSQLAS

SEQ ID NO: 1347 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAFYWSQLAS

SEQ ID NO: 1348 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAIYWAQLAS

SEQ ID NO: 1349 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAVYWSQLAS

SEQ ID NO: 1350 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFALYWSQLAS

SEQ ID NO: 1351 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
YTFAFYWSQLAS

SEQ ID NO: 1352 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  C-term NH2
LTFAAYWEALAA

SEQ ID NO: 1353 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  C-term NH2
LTFAAYWSQLAS

SEQ ID NO: 1354 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (9)..(9): Alpha-Me S5-pentenyl-alanine olefin amino acid connected by an all-carbon crosslinker comprising one double bond
  C-term NH2
FAAYWSALAA

SEQ ID NO: 1355 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (9)..(9): Alpha-Me S5-pentenyl-alanine olefin amino acid connected by an all-carbon crosslinker comprising one double bond
  C-term NH2
FAAYWQALAAA

SEQ ID NO: 1356 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LHFAAYWAQLAS

SEQ ID NO: 1357 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1358 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAHWAQLAS

SEQ ID NO: 1359 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAHLAS

SEQ ID NO: 1360 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAH

SEQ ID NO: 1361 - protein, 13 aa, Artificial Sequence
  Description of Artificial Sequence: Synthetic peptide
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
HLTFAAYWAQLAA

SEQ ID NO: 1362 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
HHFAAYWAQLAS

SEQ ID NO: 1363 - protein, 14 aa, Artificial Sequence
  Description of Artificial Sequence: Synthetic peptide
  N-term Ac
  MOD_RES (1)..(1): D-amino acid
  MOD_RES (2)..(2): 2-aminoisobutyric acid
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  C-term NH2
AXWTFAVYWSQLAS

SEQ ID NO: 1364 - protein, 13 aa, Artificial Sequence
  Description of Artificial Sequence: Synthetic peptide
  N-term Ac
  MOD_RES (1)..(1): 2-aminoisobutyric acid
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
XWTFAHYWAQLAS

SEQ ID NO: 1365 - protein, 14 aa, Artificial Sequence
  Description of Artificial Sequence: Synthetic peptide
  N-term Ac
  MOD_RES (1)..(1): 2-aminoisobutyric acid
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  C-term NH2
XAWTFAHYWAQLAS

SEQ ID NO: 1366 - protein, 13 aa, Artificial Sequence
  Description of Artificial Sequence: Synthetic peptide
  N-term Ac
  MOD_RES (1)..(1): D-amino acid
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
FWTFAHYWAQLAS

SEQ ID NO: 1367 - protein, 14 aa, Artificial Sequence
  Description of Artificial Sequence: Synthetic peptide
  N-term Ac
  MOD_RES (1)..(1): 2-aminoisobutyric acid
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  C-term NH2
XWWTFAHYWAQLAS

SEQ ID NO: 1368 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFALYWSQLAS

SEQ ID NO: 1369 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Norleucine
  MOD_RES (11)..(11): Alpha-Me S5-pentenyl-alanine olefin amino acid connected by an all-carbon crosslinker comprising one double bond
  C-term NH2
WTFALYWSQLAS

SEQ ID NO: 1370 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): D-amino acid
  C-term NH2
LTFAAYWSQLAA

SEQ ID NO: 1371 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWARLAA

SEQ ID NO: 1372 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAHLAA

SEQ ID NO: 1373 - protein, 12 aa, Artificial Sequence
  Description of Artificial Sequence: Synthetic peptide
  N-term Ac
  MOD_RES (1)..(1): D-amino acid
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ATFAAYWAQLAS

SEQ ID NO: 1374 - protein, 12 aa, Artificial Sequence
  Description of Artificial Sequence: Synthetic peptide
  N-term Ac
  MOD_RES (1)..(1): 2-aminoisobutyric acid
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
XTFAAYWAQLAS

SEQ ID NO: 1375 - protein, 12 aa, Artificial Sequence
  Description of Artificial Sequence: Synthetic peptide
  N-term Ac
  MOD_RES (1)..(1): Alpha-Me-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAAYWAQLAS

SEQ ID NO: 1376 - protein, 12 aa, Artificial Sequence
  Description of Artificial Sequence: Synthetic peptide
  N-term Ac
  MOD_RES (1)..(1): Alpha-Me-Trp
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAAYWAQLAS

SEQ ID NO: 1377 - protein, 12 aa, Artificial Sequence
  Description of Artificial Sequence: Synthetic peptide
  N-term Ac
  MOD_RES (1)..(1): N-methyl-Leu
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1378 - protein, 12 aa, Artificial Sequence
  Description of Artificial Sequence: Synthetic peptide
  N-term Ac
  MOD_RES (2)..(2): N-methyl-Thr
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1379 - protein, 12 aa, Artificial Sequence
  Description of Artificial Sequence: Synthetic peptide
  N-term Ac
  MOD_RES (2)..(2): Sarcosine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LXFAAYWAQLAS

SEQ ID NO: 1380 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LGFAAYWAQLAS

SEQ ID NO: 1381 - protein, 12 aa, Artificial Sequence
  Description of Artificial Sequence: Synthetic peptide
  N-term Ac
  MOD_RES (3)..(3): N-methyl-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1382 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAYWAQLAS

SEQ ID NO: 1383 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAAYWAQLAA

SEQ ID NO: 1384 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAA

SEQ ID NO: 1385 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAAYWSQLAS

SEQ ID NO: 1386 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAALAS

SEQ ID NO: 1387 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): homo-cyclohexyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1388 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAAYWAQGAS

SEQ ID NO: 1389 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1390 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Phe-3CF3
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1391 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): 1-Naphthalanine
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1392 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Bi-Phe
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1393 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAAYWAQLAS

SEQ ID NO: 1394 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWVQLAS

SEQ ID NO: 1395 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAWWAQLAS

SEQ ID NO: 1396 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAVYWSQLAS

SEQ ID NO: 1397 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFYWAQLAS

SEQ ID NO: 1398 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFALYWSQLAS

SEQ ID NO: 1399 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAFYWAQLAS

SEQ ID NO: 1400 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
VTFAAYWSQLAS

SEQ ID NO: 1401 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAHWAQLAS

SEQ ID NO: 1402 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAH

SEQ ID NO: 1403 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAHLAS

SEQ ID NO: 1404 - protein, 14 aa, Artificial Sequence
  Description of Artificial Sequence: Synthetic peptide
  N-term Ac
  MOD_RES (1)..(1): D-amino acid
  MOD_RES (2)..(2): 2-aminoisobutyric acid
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  C-term NH2
AXWTFAVYWSQLAS

SEQ ID NO: 1405 - protein, 13 aa, Artificial Sequence
  Description of Artificial Sequence: Synthetic peptide
  N-term Ac
  MOD_RES (1)..(1): 2-aminoisobutyric acid
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
XWTFAHYWAQLAS

SEQ ID NO: 1406 - protein, 14 aa, Artificial Sequence
  Description of Artificial Sequence: Synthetic peptide
  N-term Ac
  MOD_RES (1)..(1): 2-aminoisobutyric acid
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  C-term NH2
XAWTFAHYWAQLAS

SEQ ID NO: 1407 - protein, 13 aa, Artificial Sequence
  Description of Artificial Sequence: Synthetic peptide
  N-term Ac
  MOD_RES (1)..(1): D-amino acid
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
FWTFAHYWAQLAS

SEQ ID NO: 1408 - protein, 14 aa, Artificial Sequence
  Description of Artificial Sequence: Synthetic peptide
  N-term Ac
  MOD_RES (1)..(1): 2-aminoisobutyric acid
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  C-term NH2
XWWTFAHYWAQLAS

SEQ ID NO: 1409 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFALYWSQLAS

SEQ ID NO: 1410 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Norleucine
  MOD_RES (11)..(11): Alpha-Me S5-pentenyl-alanine olefin amino acid connected by an all-carbon crosslinker comprising one double bond
  C-term NH2
WTFALYWSQLAS

SEQ ID NO: 1411 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): D-amino acid
  C-term NH2
LTFAAYWSQLAA

SEQ ID NO: 1412 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWARLAA

SEQ ID NO: 1413 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAHLAA

SEQ ID NO: 1414 - protein, 12 aa, Artificial Sequence
  Description of Artificial Sequence: Synthetic peptide
  N-term Ac
  MOD_RES (1)..(1): D-amino acid
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ATFAAYWAQLAS

SEQ ID NO: 1415 - protein, 12 aa, Artificial Sequence
  Description of Artificial Sequence: Synthetic peptide
  N-term Ac
  MOD_RES (1)..(1): 2-aminoisobutyric acid
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
XTFAAYWAQLAS

SEQ ID NO: 1416 - protein, 12 aa, Artificial Sequence
  Description of Artificial Sequence: Synthetic peptide
  N-term Ac
  MOD_RES (1)..(1): Alpha-Me-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAAYWAQLAS

SEQ ID NO: 1417 - protein, 12 aa, Artificial Sequence
  Description of Artificial Sequence: Synthetic peptide
  N-term Ac
  MOD_RES (1)..(1): Alpha-Me-Trp
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAAYWAQLAS

SEQ ID NO: 1418 - protein, 12 aa, Artificial Sequence
  Description of Artificial Sequence: Synthetic peptide
  N-term Ac
  MOD_RES (1)..(1): N-methyl-Leu
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1419 - protein, 12 aa, Artificial Sequence
  Description of Artificial Sequence: Synthetic peptide
  N-term Ac
  MOD_RES (2)..(2): N-methyl-Thr
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1420 - protein, 12 aa, Artificial Sequence
  Description of Artificial Sequence: Synthetic peptide
  N-term Ac
  MOD_RES (2)..(2): Sarcosine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LXFAAYWAQLAS

SEQ ID NO: 1421 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAYWAQLAS

SEQ ID NO: 1422 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAAYWAQLAA

SEQ ID NO: 1423 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAA

SEQ ID NO: 1424 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAVYWSQLAS

SEQ ID NO: 1425 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
YTFAFYWSQLAS

SEQ ID NO: 1426 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (9)..(9): Alpha-Me S5-pentenyl-alanine olefin amino acid connected by an all-carbon crosslinker comprising one double bond
  C-term NH2
FAAYWSALAA

SEQ ID NO: 1427 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEYWVQLAS

SEQ ID NO: 1428 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEHWAQLAA

SEQ ID NO: 1429 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEYWAQLAS

SEQ ID NO: 1430 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWVQLAA

SEQ ID NO: 1431 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWAQLAS

SEQ ID NO: 1432 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1433 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1434 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1435 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAAYWAQGAS

SEQ ID NO: 1436 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1437 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  C-term NH2
LTFAAYWSQLAS

SEQ ID NO: 1438 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1439 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 1440 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1441 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAAYWAQGAS

SEQ ID NO: 1442 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEYWVALAS

SEQ ID NO: 1443 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEHWAALAA

SEQ ID NO: 1444 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEYWAALAS

SEQ ID NO: 1445 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWVALAA

SEQ ID NO: 1446 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWAALAS

SEQ ID NO: 1447 - protein, 12 aa, Artificial Sequence
  Description of Artificial Sequence: Synthetic peptide
  N-term Pam
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAS

SEQ ID NO: 1448 - protein, 12 aa, Artificial Sequence
  Description of Artificial Sequence: Synthetic peptide
  N-term Pam
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEYWAQLAS

SEQ ID NO: 1449 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWLQLAS

SEQ ID NO: 1450 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWLQLAS

SEQ ID NO: 1451 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEHWLQLAS

SEQ ID NO: 1452 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLAS

SEQ ID NO: 1453 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWSQLAS

SEQ ID NO: 1454 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAAYWAQLAS

SEQ ID NO: 1455 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAS

SEQ ID NO: 1456 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHAm
LTFAHYWAQLAS

SEQ ID NO: 1457 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHiAm
LTFAHYWAQLAS

SEQ ID NO: 1458 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnPr3Ph
LTFAHYWAQLAS

SEQ ID NO: 1459 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnBu3,3Me
LTFAHYWAQLAS

SEQ ID NO: 1460 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnBu
LTFAHYWAQLAS

SEQ ID NO: 1461 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnPr
LTFAHYWAQLAS

SEQ ID NO: 1462 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnEt2Ch
LTFAHYWAQLAS

SEQ ID NO: 1463 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHHex
LTFAHYWAQLAS

SEQ ID NO: 1464 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHmdPeg2
LTFAAYWAQLAS

SEQ ID NO: 1465 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHmdPeg2
LTFAAYWAQLAA

SEQ ID NO: 1466 - protein, 12 aa, Artificial Sequence
  Description of Artificial Sequence: Synthetic peptide
  N-term Ac
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (11)..(11): Alpha-Me S8-octenyl-alanine olefin amino acid connected by an all-carbon crosslinker comprising one double bond
  C-term NH2
LTFAAYWAALAS

SEQ ID NO: 1467 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou
  MOD_RES (11)..(11): Alpha-Me S5-pentenyl-alanine olefin amino acid connected by an all-carbon crosslinker comprising one double bond
  C-term NH2
LTFAAYWXQLAS

SEQ ID NO: 1468 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Cou
  MOD_RES (11)..(11): Alpha-Me S5-pentenyl-alanine olefin amino acid connected by an all-carbon crosslinker comprising one double bond
  C-term NH2
LTFAXYWAQLAS

SEQ ID NO: 1469 - protein, 12 aa, Artificial Sequence
  Description of Artificial Sequence: Synthetic peptide
  N-term Ac
  MOD_RES (1)..(1): Cou
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
XTFAAYWAQLAS

SEQ ID NO: 1470 - protein, 12 aa, Artificial Sequence
  Description of Artificial Sequence: Synthetic peptide
  N-term H
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAA

SEQ ID NO: 1471 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
HHFAAYWAQLAS

SEQ ID NO: 1472 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAAYWSQLAS

SEQ ID NO: 1473 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Cou
  MOD_RES (11)..(11): Alpha-Me S5-pentenyl-alanine olefin amino acid connected by an all-carbon crosslinker comprising one double bond
  C-term NH2
LTFAHXWAQLAS

SEQ ID NO: 1474 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou2
  MOD_RES (11)..(11): Alpha-Me S5-pentenyl-alanine olefin amino acid connected by an all-carbon crosslinker comprising one double bond
  C-term NH2
LTFAAYWXQLAS

SEQ ID NO: 1475 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Cou2
  MOD_RES (11)..(11): Alpha-Me S5-pentenyl-alanine olefin amino acid connected by an all-carbon crosslinker comprising one double bond
  C-term NH2
LTFAXYWAQLAS

SEQ ID NO: 1476 - protein, 12 aa, Artificial Sequence
  Description of Artificial Sequence: Synthetic peptide
  N-term Ac
  MOD_RES (1)..(1): Cou2
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
XTFAAYWAQLAS

SEQ ID NO: 1477 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Cou2
  MOD_RES (11)..(11): Alpha-Me S5-pentenyl-alanine olefin amino acid connected by an all-carbon crosslinker comprising one double bond
  C-term NH2
LTFAAXWAQLAS

SEQ ID NO: 1478 - protein, 12 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1479 - protein, 12 aa, Artificial Sequence
  Description of Artificial Sequence: Synthetic peptide
  N-term Hexac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1480 - protein, 12 aa, Artificial Sequence
  Description of Artificial Sequence: Synthetic peptide
  N-term Napac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1481 - protein, 12 aa, Artificial Sequence
  Description of Artificial Sequence: Synthetic peptide
  N-term Pam
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1482 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYAAQLAS

SEQ ID NO: 1483 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid that is not connected by a crosslinker
  MOD_RES (11)..(11): Alpha-Me S5-pentenyl-alanine olefin amino acid that is not connected by a crosslinker
  C-term NH2
LTAAHYWAQLAS

SEQ ID NO: 1484 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYFAQLAS

SEQ ID NO: 1485 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHWAAQLAS

SEQ ID NO: 1486 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYAWQLAS

SEQ ID NO: 1487 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYAAQWAS

SEQ ID NO: 1488 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTWAHYWAQLAS

SEQ ID NO: 1489 - protein, 12 aa, Artificial Sequence
  Description of Artificial Sequence: Synthetic peptide
  N-term Ac
  MOD_RES (3)..(3): 1-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWAQLAS

SEQ ID NO: 1490 - protein, 12 aa, Artificial Sequence
  Description of Artificial Sequence: Synthetic peptide
  N-term Ac
  MOD_RES (1)..(12): D-amino acid
  C-term NH2
TAWYANFEKLLR

SEQ ID NO: 1491 - protein, 12 aa, Artificial Sequence
  Description of Artificial Sequence: Synthetic peptide
  N-term Ac
  MOD_RES (1)..(6): D-amino acid
  MOD_RES (7)..(7): D-Phe-4CF3
  MOD_RES (8)..(12): D-amino acid
  C-term NH2
TAWYANFEKLLR

SEQ ID NO: 1492 - protein, 12 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me alkyne 1,4 triazole (5 carbon) alanine olefin amino acid connected by an all-carbon crosslinker comprising one double bond
  C-term NH2
FAAYWEXLAAAA

SEQ ID NO: 1493 - protein, 12 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me alkyne 1,4 triazole (5 carbon) alanine olefin amino acid connected by an all-carbon crosslinker comprising one double bond
  MOD_RES (11)..(11): 2-aminoisobutyric acid
  C-term NH2
FAAYWEXLAAXA

SEQ ID NO: 1494 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLASAL

SEQ ID NO: 1495 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAL

SEQ ID NO: 1496 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAM

SEQ ID NO: 1497 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): homo-Leu
  C-term NH2
LTFAAYWAQLASAL

SEQ ID NO: 1498 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAF

SEQ ID NO: 1499 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAI

SEQ ID NO: 1500 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Cyclohexyl-Gly
  C-term NH2
LTFAAYWAQLASAG

SEQ ID NO: 1501 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): 2-aminoisobutyric acid
  C-term NH2
LTFAAYWAQLASAX

SEQ ID NO: 1502 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAA

SEQ ID NO: 1503 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (11)..(11): Alpha-Me S5-pentenyl-alanine olefin amino acid connected by an all-carbon crosslinker comprising one double bond
  misc_feature (11)..(13): Crosslink between residues
  MOD_RES (13)..(13): Alpha-Me S5-pentenyl-alanine olefin amino acid connected by an all-carbon crosslinker comprising one double bond
  MOD_RES (14)..(14): Norleucine
  C-term NH2
LTFAAYWAALASAL

SEQ ID NO: 1504 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (11)..(11): Alpha-Me S5-pentenyl-alanine olefin amino acid connected by an all-carbon crosslinker comprising one double bond
  misc_feature (11)..(13): Crosslink between residues
  MOD_RES (13)..(13): Alpha-Me S5-pentenyl-alanine olefin amino acid connected by an all-carbon crosslinker comprising one double bond
  C-term NH2
LTFAAYWAALASAA

SEQ ID NO: 1505 - protein, 12 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me alkyne 1,4 triazole (5 carbon) alanine olefin amino acid connected by an all-carbon crosslinker comprising one double bond
  MOD_RES (12)..(12): Norleucine
  C-term NH2
FAAYWEXLAAAL

SEQ ID NO: 1506 - protein, 12 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me alkyne 1,4 triazole (5 carbon) alanine olefin amino acid connected by an all-carbon crosslinker comprising one double bond
  C-term NH2
FAAYWEXLAAAL

SEQ ID NO: 1507 - protein, 12 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me alkyne 1,4 triazole (5 carbon) alanine olefin amino acid connected by an all-carbon crosslinker comprising one double bond
  C-term NH2
FAAYWEXLAAAM

SEQ ID NO: 1508 - protein, 12 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me alkyne 1,4 triazole (5 carbon) alanine olefin amino acid connected by an all-carbon crosslinker comprising one double bond
  MOD_RES (12)..(12): homo-Leu
  C-term NH2
FAAYWEXLAAAL

SEQ ID NO: 1509 - protein, 12 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me alkyne 1,4 triazole (5 carbon) alanine olefin amino acid connected by an all-carbon crosslinker comprising one double bond
  C-term NH2
FAAYWEXLAAAF

SEQ ID NO: 1510 - protein, 12 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me alkyne 1,4 triazole (5 carbon) alanine olefin amino acid connected by an all-carbon crosslinker comprising one double bond
  C-term NH2
FAAYWEXLAAAI

SEQ ID NO: 1511 - protein, 12 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me alkyne 1,4 triazole (5 carbon) alanine olefin amino acid connected by an all-carbon crosslinker comprising one double bond
  MOD_RES (12)..(12): Cyclohexyl-Gly
  C-term NH2
FAAYWEXLAAAG

SEQ ID NO: 1512 - protein, 12 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me alkyne 1,4 triazole (5 carbon) alanine olefin amino acid connected by an all-carbon crosslinker comprising one double bond
  MOD_RES (12)..(12): Cyclohexyl-Ala
  C-term NH2
FAAYWEXLAAAA

SEQ ID NO: 1513 - protein, 12 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me alkyne 1,4 triazole (5 carbon) alanine olefin amino acid connected by an all-carbon crosslinker comprising one double bond
  MOD_RES (12)..(12): 2-aminoisobutyric acid
  C-term NH2
FAAYWEXLAAAX

SEQ ID NO: 1514 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): 2-aminoisobutyric acid
  C-term NH2
LTFAAYWAQLAAAXV

SEQ ID NO: 1515 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): 2-aminoisobutyric acid
  C-term NH2
LTFAAYWAQLAAAXV

SEQ ID NO: 1516 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (13)..(13): 2-aminoisobutyric acid
  C-term NH2
LTFAAYWAQLASXAA

SEQ ID NO: 1517 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (13)..(13): 2-aminoisobutyric acid
  C-term NH2
LTFAAYWAQLASXAA

SEQ ID NO: 1518 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (15)..(16): Norleucine
  C-term NH2
HLTFAHHWHQLAAALL

SEQ ID NO: 1519 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  C-term NH2
DLTFAHHWHQLARRLV

SEQ ID NO: 1520 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  C-term NH2
HHTFAHHWHQLAAAML

SEQ ID NO: 1521 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (13)..(13): Cyclohexyl-Ala
  C-term NH2
FAHHWHQLARRDA

SEQ ID NO: 1522 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  C-term NH2
FAHHWHQLAHRFV

SEQ ID NO: 1523 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (15)..(15): homo-Leu
  C-term NH2
HLTFAHHWHQLAAALA

SEQ ID NO: 1524 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (15)..(15): Cyclohexyl-Gly
  MOD_RES (16)..(16): D-amino acid
  C-term NH2
DLTFAHHWHQLARRGL

SEQ ID NO: 1525 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (15)..(15): Cyclohexyl-Gly
  MOD_RES (16)..(16): D-amino acid
  C-term NH2
DLTFAHHWHQLARRGL

SEQ ID NO: 1526 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (15)..(15): Cyclohexyl-Ala
  MOD_RES (16)..(16): D-amino acid
  C-term NH2
HHTFAHHWHQLAAAAV

SEQ ID NO: 1527 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (13)..(13): D-amino acid
  C-term NH2
FAHHWHQLARRDA

SEQ ID NO: 1528 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (12)..(12): 2-aminoisobutyric acid
  C-term NH2
FAHHWHQLAHRXG

SEQ ID NO: 1529 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (12)..(12): Norleucine
  C-term NH2
FAAYWAQLAHHLL

SEQ ID NO: 1530 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (13)..(13): Norleucine
  C-term NH2
FAAYWSALAHQAL

SEQ ID NO: 1531 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (12)..(12): Cyclohexyl-Gly
  MOD_RES (13)..(13): D-amino acid
  C-term NH2
FAAYWVQLAQHGL

SEQ ID NO: 1532 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (12)..(12): Norleucine
  MOD_RES (13)..(13): D-amino acid
  C-term NH2
FAAYWTALAQQLV

SEQ ID NO: 1533 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (11)..(11): 2-aminoisobutyric acid
  MOD_RES (13)..(13): D-amino acid
  C-term NH2
FAAYWYQLAHXAA

SEQ ID NO: 1534 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAHHLA

SEQ ID NO: 1535 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAHHLA

SEQ ID NO: 1536 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAHQLV

SEQ ID NO: 1537 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAHQLV

SEQ ID NO: 1538 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAQQML

SEQ ID NO: 1539 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAQQML

SEQ ID NO: 1540 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (13)..(13): 2-aminoisobutyric acid
  MOD_RES (14)..(14): homo-Leu
  C-term NH2
LTFAAYWAQLAHXLV

SEQ ID NO: 1541 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLAAHFA

SEQ ID NO: 1542 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (15)..(15): Norleucine
  MOD_RES (16)..(16): D-amino acid
  C-term NH2
HLTFAHHWHQLAAALL

SEQ ID NO: 1543 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (16)..(16): D-amino acid
  C-term NH2
DLTFAHHWHQLARRLA

SEQ ID NO: 1544 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (16)..(16): D-amino acid
  C-term NH2
HHTFAHHWHQLAAAMV

SEQ ID NO: 1545 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  C-term NH2
FAHHWHQLARRDA

SEQ ID NO: 1546 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (13)..(13): Cyclohexyl-Ala
  C-term NH2
FAHHWHQLAHRFA

SEQ ID NO: 1547 - protein, 11 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  C-term NHAm
FAAYWEALAAA

SEQ ID NO: 1548 - protein, 11 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  C-term NHiAm
FAAYWEALAAA

SEQ ID NO: 1549 - protein, 11 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  C-term NHnPr3Ph
FAAYWEALAAA

SEQ ID NO: 1550 - protein, 11 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  C-term NHnBu33Me
FAAYWEALAAA

SEQ ID NO: 1551 - protein, 11 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  C-term NHnPr
FAAYWEALAAA

SEQ ID NO: 1552 - protein, 11 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  C-term NHnEt2Ch
FAAYWEALAAA

SEQ ID NO: 1553 - protein, 11 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  C-term NHnEt2Cp
FAAYWEALAAA

SEQ ID NO: 1554 - protein, 11 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  C-term NHHex
FAAYWEALAAA

SEQ ID NO: 1555 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLAAAIA

SEQ ID NO: 1556 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLAAAIA

SEQ ID NO: 1557 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAALAAAMA

SEQ ID NO: 1558 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAALAAAMA

SEQ ID NO: 1559 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAAIA

SEQ ID NO: 1560 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAAIA

SEQ ID NO: 1561 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAALAAAMA

SEQ ID NO: 1562 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAALAAAMA

SEQ ID NO: 1563 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAALAAAIV

SEQ ID NO: 1564 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAALAAAIV

SEQ ID NO: 1565 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAAMV

SEQ ID NO: 1566 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
LTFAAYWAALAAALV

SEQ ID NO: 1567 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
LTFAAYWAALAAALV

SEQ ID NO: 1568 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAAIL

SEQ ID NO: 1569 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAAIL

SEQ ID NO: 1570 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAALAAAML

SEQ ID NO: 1571 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAAALL

SEQ ID NO: 1572 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAAALL

SEQ ID NO: 1573 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  C-term NH2
FAAYWEALAAAMA

SEQ ID NO: 1574 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (12)..(12): Norleucine
  C-term NH2
FAAYWEALAAALA

SEQ ID NO: 1575 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (13)..(13): D-amino acid
  C-term NH2
FAAYWEALAAAIA

SEQ ID NO: 1576 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (13)..(13): D-amino acid
  C-term NH2
FAAYWEALAAAMA

SEQ ID NO: 1577 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (12)..(12): Norleucine
  MOD_RES (13)..(13): D-amino acid
  C-term NH2
FAAYWEALAAALA

SEQ ID NO: 1578 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (13)..(13): D-amino acid
  C-term NH2
FAAYWEALAAAIV

SEQ ID NO: 1579 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (13)..(13): D-amino acid
  C-term NH2
FAAYWEALAAAMV

SEQ ID NO: 1580 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (12)..(12): Norleucine
  MOD_RES (13)..(13): D-amino acid
  C-term NH2
FAAYWEALAAALV

SEQ ID NO: 1581 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (13)..(13): D-amino acid
  C-term NH2
FAAYWEALAAAIL

SEQ ID NO: 1582 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (13)..(13): D-amino acid
  C-term NH2
FAAYWEALAAAML

SEQ ID NO: 1583 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (12)..(12): Norleucine
  MOD_RES (13)..(13): D-amino acid
  C-term NH2
FAAYWEALAAALL

SEQ ID NO: 1584 - protein, 13 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (9)..(9): Alpha-Me alkyne 1,4 triazole (5 carbon) alanine olefin amino acid connected by an all-carbon crosslinker comprising one double bond
  MOD_RES (12)..(12): Norleucine
  MOD_RES (13)..(13): D-amino acid
  C-term NH2
FAAYWEALAAALL

SEQ ID NO: 1585 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAA

SEQ ID NO: 1586 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAA

SEQ ID NO: 1587 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
WTFAFYWSQLAAVAA

SEQ ID NO: 1588 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
WTFAFYWSQLAAVAA

SEQ ID NO: 1589 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
WTFAVYWSQLAAVA

SEQ ID NO: 1590 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
WTFAVYWSQLAAVA

SEQ ID NO: 1591 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
WTFAFYWSQLASAAA

SEQ ID NO: 1592 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
WTFAFYWSQLASAAA

SEQ ID NO: 1593 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(16): D-amino acid
  C-term NH2
WTFAVYWSQLAAVAAA

SEQ ID NO: 1594 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(16): D-amino acid
  C-term NH2
WTFAVYWSQLAAVAAA

SEQ ID NO: 1595 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLAAVG

SEQ ID NO: 1596 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLAAVG

SEQ ID NO: 1597 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLAAVQ

SEQ ID NO: 1598 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLAAVQ

SEQ ID NO: 1599 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): D-amino acid
  C-term NH2
LTFAAYWAQLASAA

SEQ ID NO: 1600 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): D-amino acid
  C-term NH2
LTFAAYWAQLASAA

SEQ ID NO: 1601 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAA

SEQ ID NO: 1602 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAA

SEQ ID NO: 1603 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Amino acid comprising two pentenyl-alanine olefin side chains, each of which is crosslinked to another amino acid as indicated
  misc_feature (11)..(14): Crosslink between residues
  MOD_RES (14)..(14): Alpha-Me alkyne 1,4 triazole (5 carbon) alanine olefin amino acid connected by an all-carbon crosslinker comprising one double bond
  C-term NH2
LTFAAYWEQLASAA

SEQ ID NO: 1604 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASLA

SEQ ID NO: 1605 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASLA

SEQ ID NO: 1606 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASWA

SEQ ID NO: 1607 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASWA

SEQ ID NO: 1608 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASVS

SEQ ID NO: 1609 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAS

SEQ ID NO: 1610 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASVG

SEQ ID NO: 1611 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): D-amino acid
  C-term NH2
ETFAVYWAQLASAA

SEQ ID NO: 1612 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ETFAVYWAQLASAA

SEQ ID NO: 1613 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ETFAVYWAQLASVA

SEQ ID NO: 1614 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ETFAVYWAQLASLA

SEQ ID NO: 1615 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ETFAVYWAQLASWA

SEQ ID NO: 1616 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ETFAKYWAQLASWA

SEQ ID NO: 1617 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ETFAVYWAQLASVS

SEQ ID NO: 1618 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ETFAVYWAQLASAS

SEQ ID NO: 1619 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ETFAVYWAQLASVG

SEQ ID NO: 1620 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): D-amino acid
  C-term NH2
LTFAVYWAQLASSA

SEQ ID NO: 1621 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): D-amino acid
  C-term NH2
ETFAVYWAQLASSA

SEQ ID NO: 1622 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): D-amino acid
  C-term NH2
LTFAVYWAQLASNA

SEQ ID NO: 1623 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): D-amino acid
  C-term NH2
ETFAVYWAQLASNA

SEQ ID NO: 1624 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): D-amino acid
  C-term NH2
LTFAVYWAQLASAA

SEQ ID NO: 1625 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAVYWAQLASVA

SEQ ID NO: 1626 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAVYWAQLASVA

SEQ ID NO: 1627 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAVYWAQLASWA

SEQ ID NO: 1628 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAVYWAQLASVS

SEQ ID NO: 1629 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAVYWAQLASVS

SEQ ID NO: 1630 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAVYWAQLASAS

SEQ ID NO: 1631 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAVYWAQLASAS

SEQ ID NO: 1632 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAVYWAQLASVG

SEQ ID NO: 1633 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAVYWAQLASVG

SEQ ID NO: 1634 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAA

SEQ ID NO: 1635 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAA

SEQ ID NO: 1636 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclopentyl-Gly
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQGASAA

SEQ ID NO: 1637 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclopentyl-Gly
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQGASAA

SEQ ID NO: 1638 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQFASAA

SEQ ID NO: 1639 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQFASAA

SEQ ID NO: 1640 - protein, 14 aa, Artificial Sequence
  Description of Artificial Sequence: Synthetic peptide
  N-term Ac
  MOD_RES (3)..(3): 3-chloro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 1641 - protein, 14 aa, Artificial Sequence
  Description of Artificial Sequence: Synthetic peptide
  N-term Ac
  MOD_RES (3)..(3): 3-chloro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 1642 - protein, 14 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 1643 - protein, 14 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 1644 - protein, 14 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 1645 - protein, 14 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 1646 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ETFAEYWAQLASAA

SEQ ID NO: 1647 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWVQLASAA

SEQ ID NO: 1648 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAHWAQLASAA

SEQ ID NO: 1649 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAEWAQLASAA

SEQ ID NO: 1650 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAASWAQLASAA

SEQ ID NO: 1651 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAEWAQLASAA

SEQ ID NO: 1652 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAASWAQLASAA

SEQ ID NO: 1653 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (11)..(11): Alpha-Me alkyne 1,4 triazole (5 carbon) alanine olefin amino acid connected by an all-carbon crosslinker comprising one double bond
  C-term NH2
LTFAAFWAQLASAA

SEQ ID NO: 1654 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (11)..(11): Alpha-Me alkyne 1,4 triazole (5 carbon) alanine olefin amino acid connected by an all-carbon crosslinker comprising one double bond
  C-term NH2
LTFAAFWAQLASAA

SEQ ID NO: 1655 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAHWAQLAAAIA

SEQ ID NO: 1656 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
ITFAFYWAQLAAAIA

SEQ ID NO: 1657 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
ITFAEHWAQLAAAIA

SEQ ID NO: 1658 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
ITFAEHWAQLAAAIA

SEQ ID NO: 1659 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
ETFAEHWAQLAAAIA

SEQ ID NO: 1660 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
ETFAEHWAQLAAAIA

SEQ ID NO: 1661 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAHWVQLAAAIA

SEQ ID NO: 1662 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
ITFAFYWVQLAAAIA

SEQ ID NO: 1663 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
ITFAEYWVQLAAAIA

SEQ ID NO: 1664 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
ITFAEHWVQLAAAIA

SEQ ID NO: 1665 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAEWAQLAAAIA

SEQ ID NO: 1666 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAFWAQLAAAIA

SEQ ID NO: 1667 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAFWAQLAAAIA

SEQ ID NO: 1668 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAHWAQLAAHFA

SEQ ID NO: 1669 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ITFAFYWAQLAAHFA

SEQ ID NO: 1670 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ITFAFYWAQLAAHFA

SEQ ID NO: 1671 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ITFAFHWAQLAAEFA

SEQ ID NO: 1672 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ITFAFHWAQLAAEFA

SEQ ID NO: 1673 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ITFAEHWAQLAAHFA

SEQ ID NO: 1674 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ITFAEHWAQLAAHFA

SEQ ID NO: 1675 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAHWVQLAAHFA

SEQ ID NO: 1676 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ITFAFYWVQLAAHFA

SEQ ID NO: 1677 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ITFAEYWVQLAAHFA

SEQ ID NO: 1678 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ITFAEHWVQLAAHFA

SEQ ID NO: 1679 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ITFAEHWVQLAAHFA

SEQ ID NO: 1680 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
ETFAEYWAALASAA

SEQ ID NO: 1681 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWVALASAA

SEQ ID NO: 1682 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAHWAALASAA

SEQ ID NO: 1683 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAEWAALASAA

SEQ ID NO: 1684 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAEWAALASAA

SEQ ID NO: 1685 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAASWAALASAA

SEQ ID NO: 1686 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAASWAALASAA

SEQ ID NO: 1687 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAALAAAIA

SEQ ID NO: 1688 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAALAAAIA

SEQ ID NO: 1689 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  C-term NH2
LTFAAYWAALAAHFA

SEQ ID NO: 1690 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEHWAQLAAHIA

SEQ ID NO: 1691 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEHWAQLAAHIA

SEQ ID NO: 1692 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAHWAQLAAHIA

SEQ ID NO: 1693 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQLAAHIA

SEQ ID NO: 1694 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAAFA

SEQ ID NO: 1695 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAAFA

SEQ ID NO: 1696 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAAWA

SEQ ID NO: 1697 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAAVA

SEQ ID NO: 1698 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAAVA

SEQ ID NO: 1699 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAALA

SEQ ID NO: 1700 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAALA

SEQ ID NO: 1701 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQLAAAIA

SEQ ID NO: 1702 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQLAAAIA

SEQ ID NO: 1703 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQLAAAFA

SEQ ID NO: 1704 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQLAAAFA

SEQ ID NO: 1705 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQLAAAVA

SEQ ID NO: 1706 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQLAAAVA

SEQ ID NO: 1707 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEHWAQLAAAIA

SEQ ID NO: 1708 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEHWAQLAAAIA

SEQ ID NO: 1709 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEHWAQLAAAWA

SEQ ID NO: 1710 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEHWAQLAAAWA

SEQ ID NO: 1711 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEHWAQLAAALA

SEQ ID NO: 1712 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEHWAQLAAALA

SEQ ID NO: 1713 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
ETFAEHWVQLAAALA

SEQ ID NO: 1714 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAAAA

SEQ ID NO: 1715 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQLAAAAA

SEQ ID NO: 1716 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): 2-aminoisobutyric acid
  C-term NH2
LTFAAYWAQLAAAXA

SEQ ID NO: 1717 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): 2-aminoisobutyric acid
  C-term NH2
LTFAAYWAQLAAAXA

SEQ ID NO: 1718 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (16)..(16): D-amino acid
  C-term NH2
LTFAAYWAQLAAAAAA

SEQ ID NO: 1719 - protein, 15 aa, Artificial Sequence
  Description of Artificial Sequence: Synthetic peptide
  N-term Ac
  MOD_RES (4)..(4): Alpha-Me R5-pentenyl-alanine olefin amino acids connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bonds8
  MOD_RES (15)..(15): D-amino acid
  C-term NH2
LTFAAYWAQLAAAIA

SEQ ID NO: 1720 - protein, 14 aa, Artificial Sequence
  Description of Artificial Sequence: Synthetic peptide
  N-term Ac
  MOD_RES (4)..(4): Alpha-Me R5-pentenyl-alanine olefin amino acids connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bonds8
  C-term NH2
LTFAAYWAQLASAA

SEQ ID NO: 1721 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQAAAALA

SEQ ID NO: 1722 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
ETFAAYWAQAAAALA

SEQ ID NO: 1723 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAEYWAQAAAALA

SEQ ID NO: 1724 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQAAAWLA

SEQ ID NO: 1725 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
ETFAAYWAQAAAWLA

SEQ ID NO: 1726 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAEYWAQAAAWLA

SEQ ID NO: 1727 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAFA

SEQ ID NO: 1728 - protein, 15 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAEYWAQAASALA

SEQ ID NO: 1729 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAEFWAQAASALA

SEQ ID NO: 1730 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAEYWSQAASALA

SEQ ID NO: 1731 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAEYWWQAASALA

SEQ ID NO: 1732 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQAAAAIA

SEQ ID NO: 1733 - protein, 15 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQAAAAIA

SEQ ID NO: 1734 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEFWAQAAAAIA

SEQ ID NO: 1735 - protein, 14 aa, Artificial Sequence
  Description of Artificial Sequence: Synthetic peptide
  N-term Pam
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
ETFAEYWAQAASAA

SEQ ID NO: 1736 - protein, 14 aa, Artificial Sequence
  Description of Artificial Sequence: Synthetic peptide
  N-term Ac
  MOD_RES (3)..(3): homo-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEFWAQAASAA

SEQ ID NO: 1737 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYAAQAASAA

SEQ ID NO: 1738 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (7)..(7): 2Nal
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYAAQAASAA

SEQ ID NO: 1739 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQAASAA

SEQ ID NO: 1740 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAF

SEQ ID NO: 1741 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQAASAFA

SEQ ID NO: 1742 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQAASAF

SEQ ID NO: 1743 - protein, 14 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQAASAF

SEQ ID NO: 1744 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAAFWAQAASAF

SEQ ID NO: 1745 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (7)..(7): 6cl-Trp
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAF

SEQ ID NO: 1746 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAAYWSQAASAF

SEQ ID NO: 1747 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAAYWWQAASAF

SEQ ID NO: 1748 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQAAAAIA

SEQ ID NO: 1749 - protein, 15 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQAAAAIA

SEQ ID NO: 1750 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (7)..(7): 6cl-Trp
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQAAAAIA

SEQ ID NO: 1751 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAFWAQAAAAIA

SEQ ID NO: 1752 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQAAAAFA

SEQ ID NO: 1753 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQAAAAFA

SEQ ID NO: 1754 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
ETFAAYWAQAAAWLA

SEQ ID NO: 1755 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
LTFAEYWAQAAAWLA

SEQ ID NO: 1756 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
ETFAEYWAQAAAWLA

SEQ ID NO: 1757 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
ETFAEYWAQAAAWLA

SEQ ID NO: 1758 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQAASAFA

SEQ ID NO: 1759 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAAYWAQAASAFA

SEQ ID NO: 1760 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
ETFAAYWAQLAAWLA

SEQ ID NO: 1761 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
LTFAEYWAQLAAWLA

SEQ ID NO: 1762 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): D-amino acid
  C-term NH2
ETFAEYWAQLAAWLA

SEQ ID NO: 1763 - protein, 14 aa, Artificial Sequence
  Description of Artificial Sequence: Synthetic peptide
  N-term Dmaac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 1764 - protein, 14 aa, Artificial Sequence
  Description of Artificial Sequence: Synthetic peptide
  N-term Hexac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 1765 - protein, 14 aa, Artificial Sequence
  Description of Artificial Sequence: Synthetic peptide
  N-term Napac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 1766 - protein, 14 aa, Artificial Sequence
  Description of Artificial Sequence: Synthetic peptide
  N-term Decac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 1767 - protein, 14 aa, Artificial Sequence
  Description of Artificial Sequence: Synthetic peptide
  N-term Admac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 1768 - protein, 14 aa, Artificial Sequence
  Description of Artificial Sequence: Synthetic peptide
  N-term Tmac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 1769 - protein, 14 aa, Artificial Sequence
  Description of Artificial Sequence: Synthetic peptide
  N-term Pam
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 1770 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQAAAALA

SEQ ID NO: 1771 - protein, 15 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQAAAAIA

SEQ ID NO: 1772 - protein, 14 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAA

SEQ ID NO: 1773 - protein, 14 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAA

SEQ ID NO: 1774 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEFWAQAASAA

SEQ ID NO: 1775 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEFWAQAASAA

SEQ ID NO: 1776 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWSQAASAA

SEQ ID NO: 1777 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWSQAASAA

SEQ ID NO: 1778 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQLASAA

SEQ ID NO: 1779 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAF

SEQ ID NO: 1780 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAF

SEQ ID NO: 1781 - protein, 14 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAA

SEQ ID NO: 1782 - protein, 14 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAAYWAQLASAA

SEQ ID NO: 1783 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAAFWAQLASAA

SEQ ID NO: 1784 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAAFWAQLASAA

SEQ ID NO: 1785 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAAYWSQLASAA

SEQ ID NO: 1786 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  C-term NH2
LTFAAYWSQLASAA

SEQ ID NO: 1787 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAEYWAQLAAALA

SEQ ID NO: 1788 - protein, 15 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALA

SEQ ID NO: 1789 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAFWAQLAAALA

SEQ ID NO: 1790 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWSQLAAALA

SEQ ID NO: 1791 - protein, 15 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALA

SEQ ID NO: 1792 - protein, 15 aa, Artificial Sequence
  Description of Artificial Sequence: Synthetic peptide
  N-term Ac
  MOD_RES (3)..(3): 3,4-difluoro-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALA

SEQ ID NO: 1793 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAFWAQLAAALA

SEQ ID NO: 1794 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAFWAQLAAALA

SEQ ID NO: 1795 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWSQLAAALA

SEQ ID NO: 1796 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWSQLAAALA

SEQ ID NO: 1797 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  MOD_RES (16)..(16): D-amino acid
  C-term NH2
LTFAAYWAQLAAAAAA

SEQ ID NO: 1798 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  MOD_RES (16)..(16): D-amino acid
  C-term NH2
LTFAAYWAQLAAAAAA

SEQ ID NO: 1799 - protein, 18 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (18)..(18): D-amino acid
  C-term NH2
LTFAAYWAQLAAAAAAAA

SEQ ID NO: 1800 - protein, 18 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (18)..(18): D-amino acid
  C-term NH2
LTFAAYWAQLAAAAAAAA

SEQ ID NO: 1801 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAEYWAQLAAALA

SEQ ID NO: 1802 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (15)..(15): Norleucine
  C-term NH2
AATFAAYWAQLAAALA

SEQ ID NO: 1803 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALAA

SEQ ID NO: 1804 - protein, 17 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (15)..(15): Norleucine
  C-term NH2
ALTFAAYWAQLAAALAA

SEQ ID NO: 1805 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQAAAALAA

SEQ ID NO: 1806 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALAA

SEQ ID NO: 1807 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAAA

SEQ ID NO: 1808 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAAA

SEQ ID NO: 1809 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAAAA

SEQ ID NO: 1810 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAAAA

SEQ ID NO: 1811 - protein, 15 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me alkyne 1,4 triazole (5 carbon) alanine olefin amino acid connected by an all-carbon crosslinker comprising one double bond
  C-term NH2
ALTFAEYWAQAASAA

SEQ ID NO: 1812 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me alkyne 1,4 triazole (5 carbon) alanine olefin amino acid connected by an all-carbon crosslinker comprising one double bond
  C-term NH2
ALTFAEYWAQAASAAA

SEQ ID NO: 1813 - protein, 15 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me alkyne 1,4 triazole (5 carbon) alanine olefin amino acid connected by an all-carbon crosslinker comprising one double bond
  C-term NH2
ALTFAEYWAQAASAA

SEQ ID NO: 1814 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (7)..(7): 6cl-Trp
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAA

SEQ ID NO: 1815 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (7)..(7): 6cl-Trp
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAEFWAQAASALA

SEQ ID NO: 1816 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (7)..(7): 6cl-Trp
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAEFWAQAASALA

SEQ ID NO: 1817 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (7)..(7): 6cl-Trp
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEFWAQAAAAIA

SEQ ID NO: 1818 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (7)..(7): 6cl-Trp
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEFWAQAAAAIA

SEQ ID NO: 1819 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAAYWAQLAAAAAAA

SEQ ID NO: 1820 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAAYWAQLAAAAAAA

SEQ ID NO: 1821 - protein, 16 aa, Artificial Sequence
  Description of Artificial Sequence: Synthetic peptide
  N-term Ac
  MOD_RES (2)..(2): Alpha-Me R-azide 1,4 triazole (6 carbon) alanine olefin amino acid connected by an all-carbon crosslinker comprising one double bond
  misc_feature (2)..(9): Crosslink between residues
  MOD_RES (5)..(5): 6cl-Trp
  MOD_RES (9)..(9): Alpha-Me alkyne 1,4 triazole (5 carbon) alanine olefin amino acid connected by an all-carbon crosslinker comprising one double bond
  MOD_RES (16)..(16): D-amino acid
  C-term NH2
FAAYWEALAAAAAAAA

SEQ ID NO: 1822 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
ETFAEYWAQLAAAAAAA

SEQ ID NO: 1823 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
ETFAEYWAQLAAAAAAA

SEQ ID NO: 1824 - protein, 18 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (18)..(18): D-amino acid
  C-term NH2
LTFAEYWAQLAAAAAAAA

SEQ ID NO: 1825 - protein, 18 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (18)..(18): D-amino acid
  C-term NH2
LTFAEYWAQLAAAAAAAA

SEQ ID NO: 1826 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (17)..(17): D-amino acid
  C-term NH2
LTFAAYWAQLAAALAAA

SEQ ID NO: 1827 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (17)..(17): D-amino acid
  C-term NH2
LTFAAYWAQLAAALAAA

SEQ ID NO: 1828 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAEYWAQAAAAAAAA

SEQ ID NO: 1829 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAEYWAQAAAAAAAA

SEQ ID NO: 1830 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAEFWAQAAAAAAAA

SEQ ID NO: 1831 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAEFWAQAAAAAAAA

SEQ ID NO: 1832 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAEYWSQAAAAAAAA

SEQ ID NO: 1833 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAEYWSQAAAAAAAA

SEQ ID NO: 1834 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQAASAAA

SEQ ID NO: 1835 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEYWAQAASAAA

SEQ ID NO: 1836 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me alkyne 1,4 triazole (5 carbon) alanine olefin amino acid connected by an all-carbon crosslinker comprising one double bond
  MOD_RES (16)..(16): D-amino acid
  C-term NH2
ALTFAEYWAQAASAAA

SEQ ID NO: 1837 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me alkyne 1,4 triazole (5 carbon) alanine olefin amino acid connected by an all-carbon crosslinker comprising one double bond
  MOD_RES (16)..(16): D-amino acid
  C-term NH2
ALTFAEYWAQAASAAA

SEQ ID NO: 1838 - protein, 17 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me alkyne 1,4 triazole (5 carbon) alanine olefin amino acid connected by an all-carbon crosslinker comprising one double bond
  MOD_RES (17)..(17): D-amino acid
  C-term NH2
ALTFAEYWAQAASAAAA

SEQ ID NO: 1839 - protein, 17 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me alkyne 1,4 triazole (5 carbon) alanine olefin amino acid connected by an all-carbon crosslinker comprising one double bond
  MOD_RES (17)..(17): D-amino acid
  C-term NH2
ALTFAEYWAQAASAAAA

SEQ ID NO: 1840 - protein, 18 aa, Artificial Sequence
  Description of Artificial Sequence: Synthetic peptide
  N-term Ac
  MOD_RES (6)..(6): Alpha-Me R-azide 1,4 triazole (6 carbon) alanine olefin amino acid connected by an all-carbon crosslinker comprising one double bond
  misc_feature (6)..(13): Crosslink between residues
  MOD_RES (12)..(12): Cyclobutyl-Ala
  MOD_RES (13)..(13): Alpha-Me alkyne 1,4 triazole (5 carbon) alanine olefin amino acid connected by an all-carbon crosslinker comprising one double bond
  MOD_RES (18)..(18): D-amino acid
  C-term NH2
AALTFAEYWAQAASAAAA

SEQ ID NO: 1841 - protein, 18 aa, Artificial Sequence
  Description of Artificial Sequence: Synthetic peptide
  N-term Ac
  MOD_RES (6)..(6): Alpha-Me R-azide 1,4 triazole (6 carbon) alanine olefin amino acid connected by an all-carbon crosslinker comprising one double bond
  misc_feature (6)..(13): Crosslink between residues
  MOD_RES (12)..(12): Cyclobutyl-Ala
  MOD_RES (13)..(13): Alpha-Me alkyne 1,4 triazole (5 carbon) alanine olefin amino acid connected by an all-carbon crosslinker comprising one double bond
  MOD_RES (18)..(18): D-amino acid
  C-term NH2
AALTFAEYWAQAASAAAA

SEQ ID NO: 1842 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
RTFAEYWAQAASAA

SEQ ID NO: 1843 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LRFAEYWAQAASAA

SEQ ID NO: 1844 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWRQAASAA

SEQ ID NO: 1845 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWARAASAA

SEQ ID NO: 1846 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAARAA

SEQ ID NO: 1847 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASRA

SEQ ID NO: 1848 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAR

SEQ ID NO: 1849 - protein, 16 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (15)..(15): Norleucine
  C-term NH2
ALTFAAYWAQLAAALA

SEQ ID NO: 1850 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LAFAEYWAQLAAALA

SEQ ID NO: 1851 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
ATFAEYWAQLAAALA

SEQ ID NO: 1852 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
AAFAEYWAQLAAALA

SEQ ID NO: 1853 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (15)..(15): Norleucine
  C-term NH2
AAAFAEYWAQLAAALA

SEQ ID NO: 1854 - protein, 17 aa, Artificial Sequence
  Description of Artificial Sequence: Synthetic peptide
  N-term Ac
  MOD_RES (6)..(6): Alpha-Me R-azide 1,4 triazole (6 carbon) alanine olefin amino acid connected by an all-carbon crosslinker comprising one double bond
  misc_feature (6)..(13): Crosslink between residues
  MOD_RES (13)..(13): Alpha-Me alkyne 1,4 triazole (5 carbon) alanine olefin amino acid connected by an all-carbon crosslinker comprising one double bond
  MOD_RES (16)..(16): Norleucine
  C-term NH2
AAAAFAEYWAQLAAALA

SEQ ID NO: 1855 - protein, 16 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (15)..(15): Norleucine
  C-term NH2
AATFAEYWAQLAAALA

SEQ ID NO: 1856 - protein, 17 aa, Artificial Sequence
  Description of Artificial Sequence: Synthetic peptide
  N-term Ac
  MOD_RES (6)..(6): Alpha-Me R-azide 1,4 triazole (6 carbon) alanine olefin amino acid connected by an all-carbon crosslinker comprising one double bond
  misc_feature (6)..(13): Crosslink between residues
  MOD_RES (13)..(13): Alpha-Me alkyne 1,4 triazole (5 carbon) alanine olefin amino acid connected by an all-carbon crosslinker comprising one double bond
  MOD_RES (16)..(16): Norleucine
  C-term NH2
AALTFAEYWAQLAAALA

SEQ ID NO: 1857 - protein, 18 aa, Artificial Sequence
  Description of Artificial Sequence: Synthetic peptide
  N-term Ac
  MOD_RES (7)..(7): Alpha-Me R-azide 1,4 triazole (6 carbon) alanine olefin amino acid connected by an all-carbon crosslinker comprising one double bond
  misc_feature (7)..(14): Crosslink between residues
  MOD_RES (14)..(14): Alpha-Me alkyne 1,4 triazole (5 carbon) alanine olefin amino acid connected by an all-carbon crosslinker comprising one double bond
  MOD_RES (18)..(18): Norleucine
  C-term NH2
AAALTFAEYWAQLAAALA

SEQ ID NO: 1858 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAEYWAQLAAALAA

SEQ ID NO: 1859 - protein, 17 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (12)..(12): Alpha-Me alkyne 1,4 triazole (5 carbon) alanine olefin amino acid connected by an all-carbon crosslinker comprising one double bond
  MOD_RES (15)..(15): Norleucine
  C-term NH2
ALTFAEYWAQLAAALAA

SEQ ID NO: 1860 - protein, 18 aa, Artificial Sequence
  Description of Artificial Sequence: Synthetic peptide
  N-term Ac
  MOD_RES (6)..(6): Alpha-Me R-azide 1,4 triazole (6 carbon) alanine olefin amino acid connected by an all-carbon crosslinker comprising one double bond
  misc_feature (6)..(13): Crosslink between residues
  MOD_RES (13)..(13): Alpha-Me alkyne 1,4 triazole (5 carbon) alanine olefin amino acid connected by an all-carbon crosslinker comprising one double bond
  MOD_RES (16)..(16): Norleucine
  C-term NH2
AALTFAEYWAQLAAALAA

SEQ ID NO: 1861 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAEYWAQAAAALAA

SEQ ID NO: 1862 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): homo-Leu
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAEYWAQLAAALAA

SEQ ID NO: 1863 - protein, 17 aa, Artificial Sequence
  Description of Artificial Sequence: Synthetic peptide
  N-term Ac
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (11)..(11): homo-Leu
  MOD_RES (12)..(12): Alpha-Me alkyne 1,4 triazole (5 carbon) alanine olefin amino acid connected by an all-carbon crosslinker comprising one double bond
  MOD_RES (15)..(15): Norleucine
  C-term NH2
ALTFAEYWAQLAAALAA

SEQ ID NO: 1864 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): N-methyl-Tyr
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALA

SEQ ID NO: 1865 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): N-methyl-Tyr
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALA

SEQ ID NO: 1866 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (7)..(7): N-methyl-Trp
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALA

SEQ ID NO: 1867 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (7)..(7): N-methyl-Trp
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALA

SEQ ID NO: 1868 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (7)..(7): Alpha-Me-Trp
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALA

SEQ ID NO: 1869 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (7)..(7): Alpha-Me-Trp
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALA

SEQ ID NO: 1870 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (8)..(8): 2-aminoisobutyric acid
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWXQLAAALA

SEQ ID NO: 1871 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (8)..(8): 2-aminoisobutyric acid
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWXQLAAALA

SEQ ID NO: 1872 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (13)..(13): 2-aminoisobutyric acid
  MOD_RES (14)..(14): Norleucine
  C-term NH2
LTFAAYWAQLAAXLA

SEQ ID NO: 1873 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (13)..(13): 2-aminoisobutyric acid
  MOD_RES (14)..(14): Norleucine
  C-term NH2
LTFAAYWAQLAAXLA

SEQ ID NO: 1874 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (13)..(13): Sarcosine
  MOD_RES (14)..(14): Norleucine
  C-term NH2
LTFAAYWAQLAAXLA

SEQ ID NO: 1875 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (13)..(13): Sarcosine
  MOD_RES (14)..(14): Norleucine
  C-term NH2
LTFAAYWAQLAAXLA

SEQ ID NO: 1876 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): 2-aminoisobutyric acid
  C-term NH2
LTFAAYWAQLAAALX

SEQ ID NO: 1877 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): 2-aminoisobutyric acid
  C-term NH2
LTFAAYWAQLAAALX

SEQ ID NO: 1878 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): N-methyl-Ala
  C-term NH2
LTFAAYWAQLAAALA

SEQ ID NO: 1879 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): N-methyl-Ala
  C-term NH2
LTFAAYWAQLAAALA

SEQ ID NO: 1880 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): Sarcosine
  C-term NH2
LTFAAYWAQLAAALX

SEQ ID NO: 1881 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (15)..(15): Sarcosine
  C-term NH2
LTFAAYWAQLAAALX

SEQ ID NO: 1882 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (16)..(16): 2-aminoisobutyric acid
  C-term NH2
LTFAAYWAQLAAALAX

SEQ ID NO: 1883 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (16)..(16): 2-aminoisobutyric acid
  C-term NH2
LTFAAYWAQLAAALAX

SEQ ID NO: 1884 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (16)..(16): N-methyl-Ala
  C-term NH2
LTFAAYWAQLAAALAA

SEQ ID NO: 1885 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (16)..(16): N-methyl-Ala
  C-term NH2
LTFAAYWAQLAAALAA

SEQ ID NO: 1886 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (16)..(16): D-amino acid
  C-term NH2
LTFAAYWAQLAAALAA

SEQ ID NO: 1887 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (16)..(16): D-amino acid
  C-term NH2
LTFAAYWAQLAAALAA

SEQ ID NO: 1888 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (16)..(16): Sarcosine
  C-term NH2
LTFAAYWAQLAAALAX

SEQ ID NO: 1889 - protein, 16 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  MOD_RES (16)..(16): Sarcosine
  C-term NH2
LTFAAYWAQLAAALAX

SEQ ID NO: 1890 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (5)..(5): Cou4
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAXYWAQLAAALA

SEQ ID NO: 1891 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (5)..(5): Cou4
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAXYWAQLAAALA

SEQ ID NO: 1892 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (8)..(8): Cou4
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWXQLAAALA

SEQ ID NO: 1893 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (12)..(12): Cou4
  MOD_RES (14)..(14): Norleucine
  C-term NH2
LTFAAYWAQLAXALA

SEQ ID NO: 1894 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (12)..(12): Cou4
  MOD_RES (14)..(14): Norleucine
  C-term NH2
LTFAAYWAQLAXALA

SEQ ID NO: 1895 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (13)..(13): Cou4
  MOD_RES (14)..(14): Norleucine
  C-term NH2
LTFAAYWAQLAAXLA

SEQ ID NO: 1896 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (13)..(13): Cou4
  MOD_RES (14)..(14): Norleucine
  C-term NH2
LTFAAYWAQLAAXLA

SEQ ID NO: 1897 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term OH
LTFAAYWAQLAAALA

SEQ ID NO: 1898 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term OH
LTFAAYWAQLAAALA

SEQ ID NO: 1899 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NHnPr
LTFAAYWAQLAAALA

SEQ ID NO: 1900 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NHnPr
LTFAAYWAQLAAALA

SEQ ID NO: 1901 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NHnBu33Me
LTFAAYWAQLAAALA

SEQ ID NO: 1902 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NHnBu33Me
LTFAAYWAQLAAALA

SEQ ID NO: 1903 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NHHex
LTFAAYWAQLAAALA

SEQ ID NO: 1904 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  N-term NHHex
LTFAAYWAQLAAALA

SEQ ID NO: 1905 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTAAAYWAQLAAALA

SEQ ID NO: 1906 - protein, 15 aa, Artificial Sequence
  Description of Artificial Sequence: Synthetic peptide
  N-term Ac
  MOD_RES (3)..(3): homo-Leu
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTLAAYWAQLAAALA

SEQ ID NO: 1907 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYAAQLAAALA

SEQ ID NO: 1908 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (7)..(7): 2Nal
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYAAQLAAALA

SEQ ID NO: 1909 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (8)..(8): Cou4
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWXQAASAA

SEQ ID NO: 1910 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (8)..(8): Cou7
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWXQAASAA

SEQ ID NO: 1911 - protein, 14 aa, Artificial Sequence
  Description of Artificial Sequence: Synthetic peptide
  N-term Dmaac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAA

SEQ ID NO: 1912 - protein, 17 aa, Artificial Sequence
  Description of Artificial Sequence: Synthetic peptide
  N-term Dmaac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAAYWAQLAAAAAAA

SEQ ID NO: 1913 - protein, 17 aa, Artificial Sequence
  Description of Artificial Sequence: Synthetic peptide
  N-term Dmaac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAEYWAQLAAAAAAA

SEQ ID NO: 1914 - protein, 15 aa, Artificial Sequence
  Description of Artificial Sequence: Synthetic peptide
  N-term Dmaac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEFWAQAAAAIA

SEQ ID NO: 1915 - protein, 15 aa, Artificial Sequence
  Description of Artificial Sequence: Synthetic peptide
  N-term Dmaac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (6)..(6): 4-carboxy-Phe
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  MOD_RES (15)..(15): D-amino acid
  C-term NH2
LTFAEFWAQAAAAIA

SEQ ID NO: 1916 - protein, 15 aa, Artificial Sequence
  Description of Artificial Sequence: Synthetic peptide
  N-term Dmaac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALA

SEQ ID NO: 1917 - protein, 16 aa, Artificial Sequence
  Description of Artificial Sequence: Synthetic peptide
  MOD_RES (1)..(1): Cou6
  MOD_RES (2)..(2): Beta-Ala
  MOD_RES (6)..(6): Alpha-Me R-azide 1,4 triazole (6 carbon) alanine olefin amino acid connected by an all-carbon crosslinker comprising one double bond
  misc_feature (6)..(13): Crosslink between residues
  MOD_RES (12)..(12): homo-Leu
  MOD_RES (13)..(13): Alpha-Me alkyne 1,4 triazole (5 carbon) alanine olefin amino acid connected by an all-carbon crosslinker comprising one double bond
  C-term NH2
XALTFAEYWAQLASAA

SEQ ID NO: 1918 - protein, 16 aa, Artificial Sequence
  Description of Artificial Sequence: Synthetic peptide
  MOD_RES (1)..(1): Cou8
  MOD_RES (2)..(2): Beta-Ala
  MOD_RES (6)..(6): Alpha-Me R-azide 1,4 triazole (6 carbon) alanine olefin amino acid connected by an all-carbon crosslinker comprising one double bond
  misc_feature (6)..(13): Crosslink between residues
  MOD_RES (12)..(12): homo-Leu
  MOD_RES (13)..(13): Alpha-Me alkyne 1,4 triazole (5 carbon) alanine olefin amino acid connected by an all-carbon crosslinker comprising one double bond
  C-term NH2
XALTFAEYWAQLASAA

SEQ ID NO: 1919 - protein, 17 aa, Artificial Sequence
  Description of Artificial Sequence: Synthetic peptide
  N-term Ac
  MOD_RES (3)..(3): 4-iodo-Phe
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAEYWAQLAAAAAAA

SEQ ID NO: 1920 - protein, 15 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (14)..(14): Norleucine
  C-term NH2
LTFAAYWAQLAAALA

SEQ ID NO: 1921 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAAYWAQLAAAAAAA

SEQ ID NO: 1922 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAEYWAQLAAAAAAA

SEQ ID NO: 1923 - protein, 17 aa, Artificial Sequence
  Description of Artificial Sequence: Synthetic peptide
  N-term Ac
  MOD_RES (4)..(4): Alpha-Me R-azide 1,5 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,5 triazole (5 carbon) alanine olefin amino acid connected by an all-carbon crosslinker comprising one double bond
  MOD_RES (17)..(17): D-amino acid
  C-term NH2
LTFAAYWAQLAAAAAAA

SEQ ID NO: 1924 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAA

SEQ ID NO: 1925 - protein, 14 aa, Artificial Sequence
  Description of Artificial Sequence: Synthetic peptide
  N-term Ac
  MOD_RES (4)..(4): Alpha-Me R-azide 1,4 triazole (4 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAA

SEQ ID NO: 1926 - protein, 14 aa, Artificial Sequence
  Description of Artificial Sequence: Synthetic peptide
  N-term Ac
  MOD_RES (4)..(4): Alpha-Me R-azide 1,4 triazole (5 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTFAEYWAQAASAA

SEQ ID NO: 1927 - protein, 14 aa, Artificial Sequence
  Description of Artificial Sequence: Synthetic peptide
  N-term Ac
  MOD_RES (4)..(4): Alpha-Me R-azide 1,5 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,5 triazole (5 carbon) alanine olefin amino acid connected by an all-carbon crosslinker comprising one double bond
  C-term NH2
LTFAEYWAQAASAA

SEQ ID NO: 1928 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): 5I-Alpha-Me alkyne 1,4 triazole (5 carbon) alanine olefin amino acid connected by an all-carbon crosslinker comprising one double bond
  C-term NH2
LTFAEYWAQAASAA

SEQ ID NO: 1929 - protein, 14 aa, Artificial Sequence
  Description of Artificial Sequence: Synthetic peptide
  N-term Ac
  MOD_RES (4)..(4): Alpha-Me R-azide 1,5 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,5 triazole (5 carbon) alanine olefin amino acid connected by an all-carbon crosslinker comprising one double bond
  C-term NH2
LTAAEYWAQAASAA

SEQ ID NO: 1930 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me alkyne 1,4 triazole (5 carbon) alanine olefin amino acid connected by an all-carbon crosslinker comprising one double bond
  C-term NH2
LTAAEYWAQAASAA

SEQ ID NO: 1931 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me alkyne 1,4 triazole (5 carbon) alanine olefin amino acid connected by an all-carbon crosslinker comprising one double bond
  C-term NH2
ALTFAEYWAQAASAA

SEQ ID NO: 1932 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R-azide 1,4 triazole (6 carbon) alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me alkyne 1,4 triazole (5 carbon) alanine olefin amino acid connected by an all-carbon crosslinker comprising one double bond
  C-term NH2
ALTAAEYWAQAASAA

SEQ ID NO: 1933 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R-azide 1,5 triazole (6 carbon) alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me alkyne 1,5 triazole (5 carbon) alanine olefin amino acid connected by an all-carbon crosslinker comprising one double bond
  C-term NH2
ALTFAEYWAQAASAA

SEQ ID NO: 1934 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R-azide 1,5 triazole (6 carbon) alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me alkyne 1,5 triazole (5 carbon) alanine olefin amino acid connected by an all-carbon crosslinker comprising one double bond
  C-term NH2
ALTAAEYWAQAASAA

SEQ ID NO: 1935 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): 5Ph-alpha-Me alkyne 1,4 triazole (5 carbon) alanine olefin amino acid connected by an all-carbon crosslinker comprising one double bond
  C-term NH2
LTFAEYWAQAASAA

SEQ ID NO: 1936 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): 5Prp-alpha-Me alkyne 1,4 triazole (5 carbon) alanine olefin amino acid connected by an all-carbon crosslinker comprising one double bond
  C-term NH2
LTFAEYWAQAASAA

SEQ ID NO: 1937 - protein, 17 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (11)..(11): Alpha-Me alkyne 1,4 triazole (5 carbon) alanine olefin amino acid connected by an all-carbon crosslinker comprising one double bond
  MOD_RES (17)..(17): D-amino acid
  C-term NH2
LTFAAYWAALAAAAAAA

SEQ ID NO: 1938 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): 5penNH2-alpha-Me alkyne 1,4 triazole (5 carbon) alanine olefin amino acid connected by an all-carbon crosslinker comprising one double bond
  C-term NH2
LTFAEYWAQAASAA

SEQ ID NO: 1939 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): 5BnzNH2-alpha-Me alkyne 1,4 triazole (5 carbon) alanine olefin amino acid connected by an all-carbon crosslinker comprising one double bond
  C-term NH2
LTFAEYWAQAASAA

SEQ ID NO: 1940 - protein, 14 aa, Artificial Sequence
  Description of Artificial Sequence: Synthetic peptide
  N-term Ac
  MOD_RES (4)..(4): Alpha-Me R-azide 1,4 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): 5prpOMe-alpha-Me alkyne 1,4 triazole (5 carbon) alanine olefin amino acid connected by an all-carbon crosslinker comprising one double bond
  C-term NH2
LTFAEYWAQAASAA

SEQ ID NO: 1941 - protein, 17 aa, Artificial Sequence
  Description of Artificial Sequence: Synthetic peptide
  N-term Ac
  MOD_RES (4)..(4): Alpha-Me R-azide 1,5 triazole (6 carbon) alanine olefin amino acid connected by an all-carbon crosslinker comprising one double bond
  misc_feature (4)..(11): Crosslink between residues
  MOD_RES (11)..(11): 4Me-alpha-Me alkyne 1,5 triazole (5 carbon) alanine olefin amino acid connected by an all-carbon crosslinker comprising one double bond
  MOD_RES (17)..(17): D-amino acid
  C-term NH2
LTFAEYWAQLAAAAAAA

SEQ ID NO: 1942 - protein, 17 aa, Artificial Sequence
  Description of Artificial Sequence: Synthetic peptide
  N-term Ac
  MOD_RES (4)..(4): Alpha-Me R-azide 1,5 triazole (6 carbon) alanine olefin amino acid connected by an all-carbon crosslinker comprising one double bond
  misc_feature (4)..(11): Crosslink between residues
  MOD_RES (11)..(11): 4Ph-alpha-Me alkyne 1,5 triazole (5 carbon) alanine olefin amino acid connected by an all-carbon crosslinker comprising one double bond
  MOD_RES (17)..(17): D-amino acid
  C-term NH2
LTFAEYWAQLAAAAAAA

SEQ ID NO: 1943 - protein, 14 aa, Artificial Sequence
  Description of Artificial Sequence: Synthetic peptide
  N-term Ac
  MOD_RES (4)..(4): Alpha-Me R-azide 1,5 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): 4Me-alpha-Me alkyne 1,5 triazole (5 carbon) alanine olefin amino acid connected by an all-carbon crosslinker comprising one double bond
  C-term NH2
LTFAEYWAQAASAA

SEQ ID NO: 1944 - protein, 14 aa, Artificial Sequence
  Description of Artificial Sequence: Synthetic peptide
  N-term Ac
  MOD_RES (4)..(4): Alpha-Me R-azide 1,5 triazole (6 carbon) alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): 4Ph-alpha-Me alkyne 1,5 triazole (5 carbon) alanine olefin amino acid connected by an all-carbon crosslinker comprising one double bond
  C-term NH2
LTFAEYWAQAASAA

SEQ ID NO: 1945 - protein, 10 aa, Artificial Sequence
  Description of Artificial Sequence: Synthetic peptide
  MOD_RES (2)..(2): Any amino acid
  MOD_RES (9)..(9): Any amino acid
FXHYWAQLXS

SEQ ID NO: 1946 - protein, 10 aa, Artificial Sequence
  Description of Artificial Sequence: Synthetic peptide
  MOD_RES (2)..(2): Any amino acid
  MOD_RES (8)..(8): Leu or Cyclobutyl-Ala
  MOD_RES (9)..(9): Any amino acid
FXEYWAQXXA

SEQ ID NO: 1947 - protein, 13 aa, Artificial Sequence
  Description of Artificial Sequence: Synthetic peptide
  N-term 5-FAM
  MOD_RES (1)..(1): Beta-Ala
  C-term NH2
ALTFEHYWAQLTS

SEQ ID NO: 1948 - protein, 6 aa, Artificial Sequence
  Description of Artificial Sequence: Synthetic 6xHis tag
HHHHHH

---

What is claimed is:

1. A method of treating cancer in a subject in need thereof, the method comprising administering to the subject a pharmaceutical composition and a therapeutically-effective amount of an additional pharmaceutically-active agent, wherein:

the pharmaceutical composition comprises trehalose and a therapeutically-effective amount of a peptidomimetic macrocycle;

administration of the therapeutically-effective amount of the peptidomimetic macrocycle reduces a side effect associated with the therapeutically-effective amount of the additional pharmaceutically-active agent; and the cancer is liposarcoma;

wherein the peptidomimetic macrocycle is a compound of the formula:

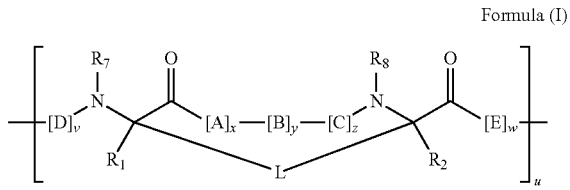

Formula (I)

or a pharmaceutically acceptable salt thereof, wherein:
each A, C, D, and E is independently an amino acid;
each B is independently an amino acid,

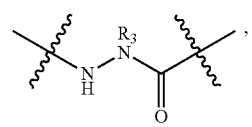

[NH-L$_3$-CO—], [—NH-L$_3$-SO$_2$—], or [—NH-L$_3$-];

each R$_1$ and R$_2$ is independently hydrogen, alkyl, alkenyl, alkynyl, arylalkyl, cycloalkyl, cycloalkylalkyl, heteroalkyl, or heterocycloalkyl, unsubstituted or substituted with halo-, or forms a macrocycle-forming linker L' connected to the alpha position of one of said D or E amino acids;

each R$_3$ is independently hydrogen, alkyl, alkenyl, alkynyl, arylalkyl, heteroalkyl, cycloalkyl, heterocycloalkyl, cycloalkylalkyl, aryl, or heteroaryl, optionally substituted with R$_5$;

each L and L' is independently a macrocycle-forming linker of the formula -L$_1$-L$_2$-;

each L$_1$, L$_2$, and L$_3$ is independently alkylene, alkenylene, alkynylene, heteroalkylene, cycloalkylene, heterocycloalkylene, arylene, heteroarylene, or [—R$_4$-K-R$_4$-]$_n$, each being optionally substituted with R$_5$, each R$_4$ is independently alkylene, alkenylene, alkynylene, heteroalkylene, cycloalkylene, heterocycloalkylene, arylene, or heteroarylene;

each K is independently O, S, SO, SO$_2$, CO, CO$_2$, or CONR$_3$;

each R$_5$ is independently halogen, alkyl, —OR$_6$, -N(R$_6$)$_2$, -SR$_6$, —SOR$_6$, —SO$_2$R$_6$, —CO$_2$R$_6$, a fluorescent moiety, a radioisotope or a therapeutic agent each R$_6$ is independently hydrogen, alkyl, alkenyl, alkynyl, arylalkyl, cycloalkylalkyl, heterocycloalkyl, a fluorescent moiety, a radioisotope or a therapeutic agent each R$_7$ is independently hydrogen, alkyl, alkenyl, alkynyl, arylalkyl, cycloalkyl, heteroalkyl, cycloalkylalkyl, heterocycloalkyl, aryl, or heteroaryl, optionally substituted with R$_5$, or part of a cyclic structure with a D residue;

each R$_8$ is independently hydrogen, alkyl, alkenyl, alkynyl, arylalkyl, cycloalkyl, heteroalkyl, cycloalkylalkyl, heterocycloalkyl, aryl, or heteroaryl, optionally substituted with R$_5$, or part of a cyclic structure with an E residue;

each v is independently an integer from 1-1000;

each w is independently an integer from 1-1000;

u is 1, 2, 3, 4, 5, 6, 7, 8, 9, or 10;

each x, y and z is independently 1, 2, 3, 4, 5, 6, 7, 8, 9, or 10; and each n is independently 1, 2, 3, 4, or 5.

2. The method of claim 1, wherein v is 3-10.

3. The method of claim 1, wherein v is 3.

4. The method of claim 1, wherein w is 3-10.

5. The method of claim 1, wherein w is 6.

6. The method of claim 1, wherein x+y+z=6.

7. The method of claim 1, wherein each L$_1$ and L$_2$ is independently alkylene, alkenylene, alkynylene, heteroalkylene, cycloalkylene, heterocycloalkylene, arylene, or heteroarylene.

8. The method of claim 1, wherein each L$_1$ and L$_2$ is independently alkylene or alkenylene.

9. The method of claim 1, wherein each R$_1$ and R$_2$ is independently hydrogen, alkyl, alkenyl, alkynyl, arylalkyl, cycloalkyl, cycloalkylalkyl, heteroalkyl, or heterocycloalkyl, unsubstituted or substituted with halo-.

10. The method of claim 1, wherein each R$_1$ and R$_2$ is independently hydrogen.

11. The method of claim 1, wherein each R$_1$ and R$_2$ is independently alkyl.

12. The method of claim 1, wherein each R$_1$ and R$_2$ is independently methyl.

13. The method of claim 1, wherein u is 1.

14. The method of claim 1, wherein:
each B is independently an amino acid;
each R$_1$ and R$_2$ is independently alkyl;
L is a macrocycle forming linker;
R$_7$ is —H;
R$_8$ is —H; and
each E is independently Ser or Ala, or d-Ala.

15. The method of claim 1, wherein the therapeutically-effective amount of the additional pharmaceutically-active agent is about 1 mg to about 250 mg.

16. The method of claim 1, wherein the side effect associated with the therapeutically-effective amount of the additional pharmaceutically-active agent is neutropenia.

17. The method of claim 1, wherein the additional pharmaceutically-active agent is palbociclib.

18. The method of claim 1, wherein:
the side effect associated with the therapeutically-effective amount of the additional pharmaceutically-active agent is neutropenia;
the additional pharmaceutically-active agent is palbociclib;
the therapeutically-effective amount of the peptidomimetic macrocycle is about 0.1 mg per kilogram body weight of the subject to about 10 mg per kilogram body weight of the subject;
the therapeutically-effective amount of palbociclib is about 75 mg to about 125 mg per day;
the pharmaceutical composition is administered to the subject on days 1, 8, and 15 during a treatment cycle; and
the treatment cycle is 28 day cycle.

19. The method of claim 18, wherein palbociclib is administered on days 1-21 of the treatment cycle.

20. The method of claim 18, wherein the therapeutically-effective amount of the peptidomimetic macrocycle is about 3.1 mg per kilogram body weight of the subject, and wherein the therapeutically-effective amount of palbociclib is about 100 mg per day.

21. The method of claim 1, wherein the peptidomimetic macrocycle comprises less than 20 amino acids, is derived from the transactivation domain of wild type human p53 protein, contains a phenylalanine, a tryptophan and a leucine amino acid in the same positions relative to each other as in the transactivation domain of wild type human p53 protein, has a single cross link spanning amino acids in the i to the i+7 position of the peptidomimetic macrocycle, has more than three amino acids between the i+7 position and the carboxyl terminus, binds to human MDM2 and MDM4, and has an observed mass of 950-975 m/e as measured by electrospray ionization-mass spectrometry.

* * * * *